US 12,018,065 B2

(12) United States Patent
Sato et al.

(10) Patent No.: US 12,018,065 B2
(45) Date of Patent: Jun. 25, 2024

(54) VARIANT NUCLEIC ACID LIBRARIES FOR CORONAVIRUS

(71) Applicant: Twist Bioscience Corporation, South San Francisco, CA (US)

(72) Inventors: Aaron Sato, Burlingame, CA (US); Qiang Liu, Palo Alto, CA (US); Tom Yuan, San Francisco, CA (US)

(73) Assignee: Twist Bioscience Corporation, South San Francisco, CA (US)

( * ) Notice: Subject to any disclaimer, the term of this patent is extended or adjusted under 35 U.S.C. 154(b) by 0 days.

(21) Appl. No.: 17/242,170

(22) Filed: Apr. 27, 2021

(65) Prior Publication Data

US 2021/0355194 A1 Nov. 18, 2021

Related U.S. Application Data

(60) Provisional application No. 63/115,568, filed on Nov. 18, 2020, provisional application No. 63/104,465, filed on Oct. 22, 2020, provisional application No. 63/073,362, filed on Sep. 1, 2020, provisional application No. 63/069,665, filed on Aug. 24, 2020, provisional application No. 63/034,896, filed on Jun. 4, 2020, provisional application No. 63/016,254, filed on Apr. 27, 2020.

(51) Int. Cl.
| | |
|---|---|
| *C07K 16/10* | (2006.01) |
| *C07K 16/00* | (2006.01) |
| *A61K 39/00* | (2006.01) |

(52) U.S. Cl.
CPC ............ *C07K 16/10* (2013.01); *C07K 16/005* (2013.01); *A61K 2039/505* (2013.01); *C07K 2317/565* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 5,368,823 | A | 11/1994 | McGraw et al. |
| 5,474,796 | A | 12/1995 | Brennan |
| 5,534,507 | A | 7/1996 | Cama et al. |
| 5,677,195 | A | 10/1997 | Winkler et al. |
| 5,843,767 | A | 12/1998 | Beattie |
| 6,013,440 | A | 1/2000 | Lipshutz et al. |
| 6,028,189 | A | 2/2000 | Blanchard |
| 6,419,883 | B1 | 7/2002 | Blanchard |
| 6,472,147 | B1 | 10/2002 | Janda et al. |
| 6,492,107 | B1 | 12/2002 | Kauffman et al. |
| 6,893,816 | B1 | 5/2005 | Beattie |
| 7,163,660 | B2 | 1/2007 | Lehmann |
| 7,202,264 | B2 | 4/2007 | Ravikumar et al. |
| 8,198,071 | B2 | 6/2012 | Goshoo et al. |
| 9,403,141 | B2 | 8/2016 | Banyai et al. |
| 9,409,139 | B2 | 8/2016 | Banyai et al. |
| 9,555,388 | B2 | 1/2017 | Banyai et al. |
| 9,677,067 | B2 | 6/2017 | Toro et al. |
| 9,745,619 | B2 | 8/2017 | Rabbani et al. |
| 9,765,387 | B2 | 9/2017 | Rabbani et al. |
| 9,833,761 | B2 | 12/2017 | Banyai et al. |
| 9,839,894 | B2 | 12/2017 | Banyai et al. |
| 9,889,423 | B2 | 2/2018 | Banyai et al. |
| 9,895,673 | B2 | 2/2018 | Peck et al. |
| 9,981,239 | B2 | 5/2018 | Banyai et al. |
| 10,053,688 | B2 | 8/2018 | Cox |
| 10,272,410 | B2 | 4/2019 | Banyai et al. |
| 10,384,188 | B2 | 8/2019 | Banyai et al. |
| 10,384,189 | B2 | 8/2019 | Peck |
| 10,417,457 | B2 | 9/2019 | Peck |
| 10,583,415 | B2 | 3/2020 | Banyai et al. |
| 10,618,024 | B2 | 4/2020 | Banyai et al. |
| 10,632,445 | B2 | 4/2020 | Banyai et al. |
| 10,639,609 | B2 | 5/2020 | Banyai et al. |
| 10,669,304 | B2 | 6/2020 | Indermuhle et al. |
| 10,744,477 | B2 | 8/2020 | Banyai et al. |
| 10,754,994 | B2 | 8/2020 | Peck |
| 10,773,232 | B2 | 9/2020 | Banyai et al. |
| 10,844,373 | B2 | 11/2020 | Cox et al. |
| 10,894,242 | B2 | 1/2021 | Marsh et al. |

(Continued)

FOREIGN PATENT DOCUMENTS

| | | |
|---|---|---|
| CN | 101277758 A | 10/2008 |
| CN | 111592594 A | 8/2020 |

(Continued)

OTHER PUBLICATIONS

Janeway, Charles A. "Immunobiology: The Immune System in Health and Disease." 2001 (Year: 2001).*

(Continued)

*Primary Examiner* — Michael Szperka
*Assistant Examiner* — Lia E Taylor
(74) *Attorney, Agent, or Firm* — Helene Laville; HEFIP, LLC

(57) ABSTRACT

Provided herein are methods and compositions relating to libraries of optimized antibodies having nucleic acids encoding for an antibody comprising modified sequences. Libraries described herein comprise nucleic acids encoding SARS-CoV-2 or ACE2 antibodies. Further described herein are protein libraries generated when the nucleic acid libraries are translated. Further described herein are cell libraries expressing variegated nucleic acid libraries described herein.

4 Claims, 88 Drawing Sheets

Specification includes a Sequence Listing.

(56) References Cited

U.S. PATENT DOCUMENTS

| | | |
|---|---|---|
| 10,894,959 B2 | 1/2021 | Cox et al. |
| 10,907,274 B2 | 2/2021 | Cox |
| 10,936,953 B2 | 3/2021 | Bramlett et al. |
| 10,969,965 B2 | 4/2021 | Malina et al. |
| 10,975,372 B2 | 4/2021 | Cox et al. |
| 10,987,648 B2 | 4/2021 | Peck et al. |
| 11,214,798 B2 | 1/2022 | Brown |
| 11,562,103 B2 | 1/2023 | Peck |
| 2001/0018512 A1 | 8/2001 | Blanchard |
| 2002/0025561 A1 | 2/2002 | Hodgson |
| 2002/0094533 A1 | 7/2002 | Hess et al. |
| 2002/0095073 A1 | 7/2002 | Jacobs et al. |
| 2002/0160536 A1 | 10/2002 | Regnier et al. |
| 2002/0164824 A1 | 11/2002 | Xiao et al. |
| 2003/0120035 A1 | 6/2003 | Gao et al. |
| 2003/0171325 A1 | 9/2003 | Gascoyne et al. |
| 2004/0087008 A1 | 5/2004 | Schembri |
| 2004/0259146 A1 | 12/2004 | Friend et al. |
| 2005/0137805 A1 | 6/2005 | Lewin et al. |
| 2005/0227235 A1 | 10/2005 | Carr et al. |
| 2005/0249739 A1 | 11/2005 | Marasco et al. |
| 2006/0127920 A1 | 6/2006 | Church et al. |
| 2007/0196834 A1 | 8/2007 | Cerrina et al. |
| 2008/0085511 A1 | 4/2008 | Peck et al. |
| 2008/0085514 A1 | 4/2008 | Peck et al. |
| 2008/0181899 A1 | 7/2008 | Papadopoulos et al. |
| 2008/0227160 A1 | 9/2008 | Kool |
| 2008/0287320 A1 | 11/2008 | Baynes et al. |
| 2008/0300842 A1 | 12/2008 | Govindarajan et al. |
| 2009/0062129 A1 | 3/2009 | McKernan et al. |
| 2009/0239759 A1 | 9/2009 | Balch |
| 2009/0285825 A1 | 11/2009 | Kini et al. |
| 2010/0004143 A1 | 1/2010 | Shibahara |
| 2010/0099103 A1 | 4/2010 | Hsieh et al. |
| 2010/0111768 A1 | 5/2010 | Banerjee et al. |
| 2010/0172917 A1 | 7/2010 | Ter Meulen et al. |
| 2010/0183616 A1 | 7/2010 | Green et al. |
| 2010/0216648 A1 | 8/2010 | Staehler et al. |
| 2010/0311960 A1 | 12/2010 | Dellinger |
| 2011/0065089 A1 | 3/2011 | Van Der Werf et al. |
| 2011/0172127 A1 | 7/2011 | Jacobson et al. |
| 2011/0217738 A1 | 9/2011 | Jacobson |
| 2012/0058906 A1 | 3/2012 | Smider et al. |
| 2012/0129704 A1 | 5/2012 | Gunderson et al. |
| 2012/0164691 A1 | 6/2012 | Eshoo et al. |
| 2012/0231968 A1 | 9/2012 | Bruhn et al. |
| 2012/0264653 A1 | 10/2012 | Carr et al. |
| 2013/0017642 A1 | 1/2013 | Milgrew et al. |
| 2013/0017977 A1 | 1/2013 | Oleinikov |
| 2013/0065017 A1 | 3/2013 | Sieber |
| 2013/0109595 A1 | 5/2013 | Routenberg |
| 2013/0109596 A1 | 5/2013 | Peterson et al. |
| 2013/0130321 A1 | 5/2013 | Staehler et al. |
| 2013/0165328 A1 | 6/2013 | Previte et al. |
| 2013/0177570 A1 | 7/2013 | Low et al. |
| 2013/0243792 A1 | 9/2013 | Vogels et al. |
| 2014/0106394 A1 | 4/2014 | Ko et al. |
| 2014/0178992 A1 | 6/2014 | Nakashima et al. |
| 2015/0038373 A1 | 2/2015 | Banyai et al. |
| 2015/0120265 A1 | 4/2015 | Amirav-Drory et al. |
| 2015/0145336 A1 | 5/2015 | Paquin et al. |
| 2015/0196917 A1 | 7/2015 | Kay et al. |
| 2016/0089651 A1 | 3/2016 | Banyai |
| 2016/0090592 A1 | 3/2016 | Banyai et al. |
| 2016/0096160 A1 | 4/2016 | Banyai et al. |
| 2016/0176953 A1 | 6/2016 | Purcell Ngambo et al. |
| 2016/0208018 A1 | 7/2016 | Chen et al. |
| 2016/0251651 A1 | 9/2016 | Banyai et al. |
| 2016/0303535 A1 | 10/2016 | Banyai et al. |
| 2016/0333340 A1 | 11/2016 | Wu |
| 2016/0339409 A1 | 11/2016 | Banyai et al. |
| 2016/0340672 A1 | 11/2016 | Banyai et al. |
| 2016/0354752 A1 | 12/2016 | Banyai et al. |
| 2017/0081716 A1 | 3/2017 | Peck |
| 2017/0088620 A1 | 3/2017 | Nioi et al. |
| 2017/0088624 A1 | 3/2017 | Fransson et al. |
| 2017/0095785 A1 | 4/2017 | Banyai et al. |
| 2017/0159044 A1 | 6/2017 | Toro et al. |
| 2017/0275357 A1 | 9/2017 | Stevens et al. |
| 2017/0327819 A1 | 11/2017 | Banyai et al. |
| 2017/0357752 A1 | 12/2017 | Diggans |
| 2017/0362339 A1 | 12/2017 | Liu et al. |
| 2017/0362589 A1 | 12/2017 | Banyai et al. |
| 2018/0029001 A1 | 2/2018 | Banyai et al. |
| 2018/0104664 A1 | 4/2018 | Fernandez |
| 2018/0142289 A1 | 5/2018 | Zeitoun et al. |
| 2018/0185482 A1 | 7/2018 | Sheng et al. |
| 2018/0253563 A1 | 9/2018 | Peck et al. |
| 2018/0264428 A1 | 9/2018 | Banyai et al. |
| 2018/0282721 A1 | 10/2018 | Cox et al. |
| 2018/0326388 A1 | 11/2018 | Banyai et al. |
| 2019/0135926 A1 | 5/2019 | Glanville |
| 2019/0314783 A1 | 10/2019 | Banyai et al. |
| 2019/0352635 A1 | 11/2019 | Toro et al. |
| 2019/0366293 A1 | 12/2019 | Banyai et al. |
| 2019/0366294 A1 | 12/2019 | Banyai et al. |
| 2020/0017907 A1 | 1/2020 | Zeitoun et al. |
| 2020/0102611 A1 | 4/2020 | Zeitoun et al. |
| 2020/0156037 A1 | 5/2020 | Banyai et al. |
| 2020/0181667 A1 | 6/2020 | Wu et al. |
| 2020/0222875 A1 | 7/2020 | Peck et al. |
| 2020/0283760 A1 | 9/2020 | Nugent et al. |
| 2020/0299322 A1 | 9/2020 | Indermuhle et al. |
| 2020/0299684 A1 | 9/2020 | Toro et al. |
| 2020/0308575 A1 | 10/2020 | Sato |
| 2020/0325235 A1 | 10/2020 | Tabibiazar et al. |
| 2020/0330953 A1 | 10/2020 | Banyai et al. |
| 2020/0342143 A1 | 10/2020 | Peck |
| 2021/0002710 A1 | 1/2021 | Gantt et al. |
| 2021/0040476 A1 | 2/2021 | Cox et al. |
| 2021/0071168 A1 | 3/2021 | Nugent et al. |
| 2021/0102192 A1 | 4/2021 | Tabibiazar et al. |
| 2021/0102195 A1 | 4/2021 | Sato et al. |
| 2021/0102198 A1 | 4/2021 | Cox et al. |
| 2021/0115594 A1 | 4/2021 | Cox et al. |
| 2021/0129108 A1 | 5/2021 | Marsh et al. |
| 2021/0142182 A1 | 5/2021 | Bramlett et al. |
| 2021/0170356 A1 | 6/2021 | Peck et al. |
| 2021/0179724 A1 | 6/2021 | Sato et al. |
| 2021/0180046 A1 | 6/2021 | Cox et al. |
| 2021/0207197 A1 | 7/2021 | Gantt et al. |
| 2021/0322432 A1 | 10/2021 | Garceau et al. |
| 2021/0332078 A1 | 10/2021 | Wu |
| 2021/0348220 A1 | 11/2021 | Zeitoun et al. |
| 2022/0032256 A1 | 2/2022 | Lackey et al. |
| 2022/0064206 A1 | 3/2022 | Fernandez et al. |
| 2022/0064313 A1 | 3/2022 | Sato et al. |
| 2022/0064628 A1 | 3/2022 | Toro et al. |
| 2022/0106586 A1 | 4/2022 | Nugent et al. |
| 2022/0106590 A1 | 4/2022 | Arbiza et al. |
| 2022/0135690 A1 | 5/2022 | Sato et al. |
| 2022/0135965 A1 | 5/2022 | Gantt et al. |
| 2022/0145289 A1 | 5/2022 | Lackey et al. |
| 2022/0206001 A1 | 6/2022 | Sato |
| 2022/0243195 A1 | 8/2022 | Nugent et al. |
| 2022/0246236 A1 | 8/2022 | Amirav-Drory |
| 2022/0259319 A1 | 8/2022 | Sato et al. |
| 2022/0259638 A1 | 8/2022 | Brown |
| 2022/0277808 A1 | 9/2022 | Arbiza et al. |
| 2022/0281989 A1 | 9/2022 | Glanville |
| 2022/0307010 A1 | 9/2022 | Sato et al. |
| 2022/0315971 A1 | 10/2022 | Wu et al. |
| 2022/0323924 A1 | 10/2022 | Lackey et al. |
| 2022/0325276 A2 | 10/2022 | Banyai et al. |
| 2022/0325278 A1 | 10/2022 | Nugent et al. |
| 2022/0348659 A1 | 11/2022 | Sato et al. |
| 2022/0356463 A1 | 11/2022 | Shen et al. |
| 2022/0356468 A1 | 11/2022 | Sato et al. |

(56) References Cited

U.S. PATENT DOCUMENTS

| | | |
|---|---|---|
| 2022/0411784 A1 | 12/2022 | Sato et al. |
| 2023/0002478 A1 | 1/2023 | Sato et al. |

FOREIGN PATENT DOCUMENTS

| | | |
|---|---|---|
| EP | 3030682 A2 | 6/2016 |
| JP | H07505530 A | 6/1995 |
| JP | 2001518086 A | 10/2001 |
| JP | 2002538790 A | 11/2002 |
| JP | 2004268394 A | 9/2004 |
| JP | 2006503586 A | 2/2006 |
| JP | 2007314746 A | 12/2007 |
| JP | 2008214343 A | 9/2008 |
| JP | 2009294195 A | 12/2009 |
| JP | 2012507513 A | 3/2012 |
| JP | 2016527313 A | 9/2016 |
| WO | WO-9320242 A1 | 10/1993 |
| WO | WO-02072791 A2 | 9/2002 |
| WO | WO-2004039953 A2 | 5/2004 |
| WO | WO-2005059096 A2 | 6/2005 |
| WO | WO-2005060520 A2 | 7/2005 |
| WO | WO-2008054543 A2 | 5/2008 |
| WO | WO-2008063135 A1 | 5/2008 |
| WO | WO-2010053443 A1 | 5/2010 |
| WO | WO-2010054007 A1 | 5/2010 |
| WO | WO-2010059543 A1 | 5/2010 |
| WO | WO-2010080833 A1 | 7/2010 |
| WO | WO-2011066389 A1 | 6/2011 |
| WO | WO-2011109031 A1 | 9/2011 |
| WO | WO-2012078312 A2 | 6/2012 |
| WO | WO-2012154201 A1 | 11/2012 |
| WO | WO-2014021938 A1 | 2/2014 |
| WO | WO-2015021080 A2 | 2/2015 |
| WO | WO-2018129329 A1 | 7/2018 |
| WO | WO-2018208864 A1 | 11/2018 |
| WO | WO-2018234793 A2 | 12/2018 |
| WO | WO-2021163265 A1 | 8/2021 |
| WO | WO-2021195326 A1 | 9/2021 |
| WO | WO-2021195385 A1 | 9/2021 |
| WO | WO-2021195418 A1 | 9/2021 |
| WO | WO-2021195485 A1 | 9/2021 |
| WO | WO-2021211586 A1 | 10/2021 |
| WO | WO-2021222315 A2 | 11/2021 |
| WO | WO-2021222316 A2 | 11/2021 |
| WO | WO-2022010934 A2 | 1/2022 |
| WO | WO-2022076326 A1 | 4/2022 |
| WO | WO-2022086866 A1 | 4/2022 |
| WO | WO-2022087293 A1 | 4/2022 |
| WO | WO-2022098662 A2 | 5/2022 |
| WO | WO-2022159620 A1 | 7/2022 |
| WO | WO-2022178137 A1 | 8/2022 |
| WO | WO-2022204309 A1 | 9/2022 |
| WO | WO-2022204316 A2 | 9/2022 |
| WO | WO-2022217004 A1 | 10/2022 |
| WO | WO-2022235579 A1 | 11/2022 |
| WO | WO-2022235584 A1 | 11/2022 |
| WO | WO-2022271884 A2 | 12/2022 |

OTHER PUBLICATIONS

Ghahroudi et al., see entire document) (Ghahroudi et al., FEBS Letters Sep. 15, 1997; 414(3): 521-526 (Year: 1997).*
Stryer, Biochemistry 4th, WH Freeman, New York. 1995 (Year: 1995).*
Colman, Research in Immunology 145.1 (1994): 33-36 (Year: 1994).*
Tian, Xiaolong et al. "Potent binding of 2019 novel coronavirus spike protein by a SARS coronavirus-specific human monoclonal antibody." Emerging microbes & infections vol. 9, 1 382-385. Feb. 17, 2020, doi:10.1080/22221751.2020.1729069 (Year: 2020).*
Kipriyanov, Sergey M., and Fabrice Le Gall. "Generation and production of engineered antibodies." Molecular biotechnology 26.1 (2004): 39-60. (Year: 2004).*
Vincke, Cecile, et al. "General strategy to humanize a camelid single-domain antibody and identification of a universal humanized nanobody scaffold." Journal of Biological Chemistry 284.5 (2009): 3273-3284. (Year: 2009).*
Arbabi Ghahroudi, M et al. "Selection and identification of single domain antibody fragments from camel heavy-chain antibodies." FEBS letters vol. 414,3 (1997): 521-6. doi: 10.1016/s0014-5793(97)01062-4 (Year: 1997).*
Arkles et al.: The Role of Polarity in the Structure of Silanes Employed in Surface Modification. Silanes and Other Coupling Agents. 5:51-64 (2009).
ATDBio. Nucleic Acid Structure, Nucleic Acids Book, 9 pages, published on Jan. 22, 2005. from: http://www.atdbio.com/content/5/Nucleic-acid-structure.
ATDBio. Solid-Phase Oligonucleotide Synthesis, Nucleic Acids Book, 20 pages, Published on Jul. 31, 2011. from: http://www.atdbio.com/content/17/Solid-phase-oligonucleotide-synthesis.
BERG: Biochemistry. 5th ED. New York (2002) 148-149.
Blanchard et al.: High-Density Oligonucleotide Arrays. Biosensors & Bioelectronics, 11(6/7):687-690 (1996).
Bogan et al.: Anatomy of hot spots in protein interfaces. J Mol Biol. 280(1):1-9 (1998).
Brocato et al.: Disruption of Adaptive Immunity Enhances Disease in SARS-CoV-2-Infected Syrian Hamsters. J Virol. 94(22):e01683-20 (2020).
Brouwer et al.: Potent neutralizing antibodies from COVID-19patients define multiple targets of vulnerability. Science. 369:643-650 (2020) .
Buermans et al.: Next Generation sequencing technology: Advances and applications, Biochimica et Biophysica Acta (BBA)—Molecular Basis of Disease, 1842:1931-1941 (2014).
Cerutti et al.: Potent SARS-CoV-2 Neutralizing Antibodies Directed Against Spike N-Terminal Domain Target a Single Supersite. Cell Host Microbe. 29(5):819-833.e7 (2021).
Chen et al.: Resistance of SARS-CoV-2 variants to neutralization by monoclonal and serum-derived polyclonal antibodies. Nat Med. 27(4):717-726 (2021).
Cheng et al.: High throughput parallel synthesis of oligonucleotides with 1536 channel synthesizer. Nucleic Acids Res. 30(18):e93 (2002).
Chi et al.: A neutralizing human antibody binds to the N-terminal domain of the Spike protein of SARS-CoV-2. Science. 369:650-655 (2020).
Cleary et al.: Production of complex nucleic acid libraries using highly parallel in situ oligonucleotide synthesis. Nat Methods. 1(3):241-248 (2004).
Cohen et al.: Human population: The next half century. Science. 302:1172-1175 (2003).
Co-pending U.S. Application No. 202117242179, inventors Sato; Aaron et al., filed on Apr. 27, 2021.
Co-pending U.S. Application No. 202117350750, inventors Cox; Anthony et al., filed on Jun. 17, 2021.
Cruse et al.: Atlas of Immunology. Third Edition. Boca Raton:CRC Press (pp. 282-283) (2010).
Davidson et al.: A high-throughput shotgun mutagenesis approach to mapping B-cell antibody epitopes. Immunology. 143(1):13-20 (2014).
Dong et al.: An interactive web-based dashboard to track COVID-19 in real time. Lancet Infect Dis 20(5):533-534 (2020).
Elsik et al.: The Genome sequence of taurine cattle: A window of ruminant biology and evolution. Science. 324:522-528 (2009).
Esparza et al.: High affinity nanobodies block SARS-CoV-2 spike receptor binding domain interaction with human angiotensin converting enzyme. Sci Rep. 10(1):22370 (2020).
Focosi et al.: Convalescent Plasma Therapy for COVID-19: State of the Art. Clin Microbiol Rev. 33(4):e00072-20 (2020).
Fodor et al.: Light-directed, spatially addressable parallel chemical synthesis. Science. 251(4995):767-773 (1991).
Gao et al.: A method for the generation of combinatorial antibody libraries using pIX phage display. PNAS 99(20):12612-12616 (2002).
GE Healthcare. AKTA oligopilot plus. Data File 18-114-66 AD©. 8 pages (2006).

(56) References Cited

OTHER PUBLICATIONS

GE Healthcare. Robust and cost-efficient oligonucleotide synthesis. Application Note 28-4058-08 AA. 4 pages (2005).
Gibson et al.: Creation of a Bacterial Cell Controlled by A Chemically Synthesized Genome. Science. 329(5989):52-56 (2010).
Hastie et al.: The impact of emerging mutations in SARS-CoV-2 on monoclonal antibody neutralization. Science. in review (2021).
Hoffmann et al.: SARS-COV-2 Cell Entry Depends on ACE2 and TMPRSS2 and Is Blocked by a Clinically Proven Protease Inhibitor. Cell. 181:271-280 e8 (2020).
Hsieh et al.: Structure-based design of prefusion-stabilized SARS-CoV-2 spikes. Science. 369(6510):1501-1505 (2020).
Hudson: Matrix Assisted Synthetic Transformations: A Mosaic of Diverse Contributions. Journal of Combinatorial Chemistry. 1(6):403-457 (1999).
Huo et al.: Neutralization of SARS-CoV-2 by Destruction of the Prefusion Spike. Cell Host Microbe. 28(3):445-454.e6 (2020).
ImmunoPrecise Announces Data from Preclinical Study of TATX-03 PolyTope™ Monoclonal Antibody Cocktail Candidate Against COVID-19 [Press release] (2021). Retrieved from https://wwwbusinesswirecom/news/home/20210219005110/en/ImmunoPrecise-Announces-Data-from-Preclinical-Study-of-TATX-03-PolyTope%E2%84%A2-Monoclonal-Antibody-Cocktail-Candidate-Against-COVID-19.
Ke et al.: Structures and distributions of SARS-CoV-2 spike proteins on intact virions. Nature. 588(7838):498-502 (2020).
Kong et al.: Parallel gene synthesis in a microfluidic device. Nucleic Acids Res. 35(8):e61 (2007).
Kosuri and Church. Large-scale de novo DNA synthesis: technologies and applications. Nature Methods. 11:499-507 (2014) Available at: http://www.nature.com/nmeth/journal/v11/n5/full/nmeth.2918.html.
Kosuri et al.: A scalable gene synthesis platform using high-fidelity DNA microchips Nat.Biotechnol. 28(12):1295-1299 (2010).
Krayden, Inc.: A Guide to Silane Solutions. Silane coupling agents. 7 pages. Published on May 31, 2005 at: http://krayden.com/pdf/xia_silane_chemistry.pdf.
Kreer et al.: Longitudinal Isolation of Potent Near-Germline SARS-CoV-2-Neutralizing Antibodies from COVID-19 Patients. Cell. 843-854.e12 (2020).
Lausted et al.: POSaM: a fast, flexible, open-source, inkjet oligonucleotide synthesizer and microarrayer. Genome Biology. 5:R58, 17 pages (2004) available at https://www.ncbi.nlm.nih.gov/pmc/articles/PMC507883/.
Lebl et al.: Economical Parallel Oligonucleotide and Peptide Synthesizer—Pet Oligator. Int. J. Peptide Res. Ther. 13(1-2):367-376 (2007).
Leproust et al.: Synthesis of high-quality libraries of long (150mer) oligonucleotides by a novel depurination controlled process. Nucleic Acids Research. 38(8):2522-2540 (2010).
Lewontin and Harti, Population genetics in forensic DNA typing. Science, 254:1745-1750, 1991.
Li et al.: Angiotensin-converting enzyme 2 is a functional receptor for the SARS coronavirus. Nature. 426(6965):450-454 (2003).
Li et al.: The functions of SARS-CoV-2 neutralizing and infection-enhancing antibodies in vitro and in mice and nonhuman primates. bioRxiv. 2020.12.31.424729 (2021).
Lim et al.: Bispecific VH/Fab antibodies targeting neutralizing and non-neutralizing Spike epitopes demonstrate enhanced potency against SARS-CoV-2. MAbs. 13(1):1893426 (2021).
Liu et al.: Cross-Neutralization of a SARS-CoV-2 Antibody to a Functionally Conserved Site Is Mediated by Avidity. Immunity. 53(6):1272-1280 e5 (2020).
Liu et al.: Potent neutralizing antibodies against multiple epitopes on SARS-CoV-2 spike. Nature. 584(7821):450-456 (2020).
Lo Conte et al.: The atomic structure of protein-protein recognition sites. J Mol Biol. 285(5):2177-2198 (1999).
Lou et al.: Cross-neutralization antibodies against SARS-CoV-2 and RBD mutations from convalescent patient antibody libraries. bioRxiv. 2020.06.06.137513 (2020).
Ma et al.: DNA synthesis, assembly and application in synthetic biology. Current Opinion in Chemical Biology. 16:260-267 (2012).
Ma et al.: Versatile surface functionalization of cyclic olefin copolymer (COC) with sputtered SiO2 thin film for potential BioMEMS applications. Journal of Materials Chemistry. 11 pages (2009).
Marovich et al.: Monoclonal Antibodies for Prevention and Treatment of COVID-19. JAMA. 324(2):131-132 (2020).
Mazor et al.: Isolation of Full-Length IgG Antibodies from Combinatorial Libraries Expressed in *Escherichia coli*; Antony S. Dimitrov (ed.), Therapeutic Antibodies: Methods and Protocols, vol. 525, Chapter 11, pp. 217-239 (2009).
McBride & Caruthers. An investigation of several deoxynucleoside phosphoramidites useful for synthesizing deoxyoligonucleotides. Tetrahedron Lett. 24:245-248 (1983).
McCallum et al.: N-terminal domain antigenic mapping reveals a site of vulnerability for SARS-CoV-2. bioRxiv. 2021.01.14.426475 (2021).
Mitra et al.: In situ localized amplification and contact replication of many individual DNA molecules. Nucleic Acids Res. 27(24):e34 (1999).
Morin et al.: Profiling the HeLa S3 transcriptome using randomly primed cDNA and massively parallel short-read sequencing. Biotechniques. 45:81-94 (2008).
Oling et al.: Large Scale Synthetic Site Saturation GPCR Libraries Reveal Novel Mutations That Alter Glucose Signaling. ACS Synth Biol. 7(9):2317-2321 (2018).
Opposition to European Patent No. 3030682 filed Mar. 3, 2021.
Parray et al.: Identification of an anti-SARS-CoV-2 receptor binding domain directed human monoclonal antibody from a naive semi-synthetic library. J Biol Chem. 295(36):12814-12821 (2020).
PCT/US2014/049834 International Preliminary Report on Patentability dated Feb. 18, 2016.
PCT/US2014/049834 International Search Report and Written Opinion dated Mar. 19, 2015.
PCT/US2014/049834, "Invitation to Pay Additional Fees and, where applicable, protest fee," dated Jan. 5, 2015.
Piccoli et al.: Mapping Neutralizing and Immunodominant Sites on the SARS-CoV-2 Spike Receptor-Binding Domain by Structure-Guided High-Resolution Serology. Cell. 183(4):1024-1042 e21 (2020).
Pirrung. How to make a DNA chip. Angew. Chem. Int. Ed. 41:1276-1289 (2002).
Piyush et al.: Convalescent plasma therapy: a promising coronavirus disease 2019 treatment strategy. Open Biol. 10:200174 (2020).
Pray. Discovery of DNA Structure and Function: Watson and Crick. Nature Education.6 pages (2008) available at: http://www.nature.com/scitable/topicpage/discovery-of-dna-structure-and-function-watson-397.
Quan et al.: Parallel on-chip gene synthesis and application to optimization of protein expression. Nature Biotechnology. 29:449-452 (2011).
Rafalski and Morgante, Corn and humans: recombination and linkage disequilibrium in two genomes of similar size. Trends in Genetics. 20(2):103-111. (2004).
Respaud et al.: Nebulization as a delivery method for mAbs in respiratory diseases. Expert Opin Drug Deliv. 12(6):1027-1039 (2015).
Rogers et al.: Isolation of potent SARS-CoV-2 neutralizing antibodies and protection from disease in a small animal model. Science. 369(6506):956-963 (2020).
Rogozin et al.: Origin and evolution of spliceosomal introns. Biology Direct, 7:11 (2012).
Rouet et al.: Fully Human VH Single Domains That Rival the Stability and Cleft Recognition of Camelid Antibodies. J Biol Chem. 290(9):11905-11917 (2015).
Saaem et al.: In situ synthesis of DNA microarray on functionalized cyclic olefin copolymer substrate ACS Applied Materials & Interfaces. 2(2):491-497 (2010).
Sargolzaei et al.: Extent of linkage disequilibrium in Holstein cattle in North America. J.Dairy Science. 91:2106-2117 (2007).
Seydoux et al.: Characterization of neutralizing antibodies from a SARS-CoV-2 infected individual. bioRxiv. (2020).

(56) References Cited

OTHER PUBLICATIONS

Shim H. Synthetic approach to the generation of antibody diversity. BMB Rep. 48(9):489-494 (2015).
Srivannavit et al.: Design and fabrication of microwell array chips for a solution-based, photogenerated acid-catalyzed parallel oligonucleotide DNA synthesis. Sensors and Actuators A. 116:150-160 (2004).
Steel, The Flow-Thru Chip a Three-dimensional biochip platform. In: Schena, Microarray Biochip Technology, Chapter 5, Natick, MA: Eaton Publishing, 2000, 33 pages.
Sullivan et al.: Convalescent Plasma: Therapeutic Hope or Hopeless Strategy in the SARS-CoV-2 Pandemic. Transfus Med Rev. 34(3):145-150 (2020).
Suryadevara et al.: Neutralizing and protective human monoclonal antibodies recognizing the N-terminal domain of the SARS-CoV-2 spike protein. Cell. 184(9):2316-2331.e15 (2021).
Tanne JH. Covid-19: FDA approves use of convalescent plasma to treat critically ill patients. BMJ. 368:m1256 (2020).
Taylor et al.: Impact of surface chemistry and blocking strategies on DNA microarrays. Nucleic Acids Research, 31(16):e87 19 pages (2003).
ter Meulen et al.: Human monoclonal antibody combination against SARS coronavirus: synergy and coverage of escape mutants. PLoS Med. 3(7):e237 (2006).
Tian et al.: Accurate multiplex gene synthesis from programmable DNA microchips. Nature. 432(7020):1050-1054 (2004).
Tostanoski et al.: Ad26 vaccine protects against SARS-CoV-2 severe clinical disease in hamsters. Nat Med. 26(11):1694-1700 (2020).
U.S. Appl. No. 14/452,429 Notice of Allowance dated Jun. 7, 2016.
U.S. Appl. No. 14/452,429 Office Action dated Apr. 9, 2015.
U.S. Appl. No. 14/452,429 Office Action dated Oct. 21, 2015.
U.S. Appl. No. 14/452,429 Restriction Requirement dated Dec. 12, 2014.
U.S. Appl. No. 14/885,962 Notice of Allowance dated Nov. 8, 2017 and Sep. 29, 2017.
U.S. Appl. No. 14/885,962 Office Action dated Dec. 16, 2016.
U.S. Appl. No. 14/885,962 Office Action dated Sep. 8, 2016.
U.S. Appl. No. 14/885,962 Restriction Requirement dated Mar. 1, 2016.
U.S. Appl. No. 14/885,963 Notice of Allowance dated May 24, 2016.
U.S. Appl. No. 14/885,963 Office Action dated Feb. 5, 2016.
U.S. Appl. No. 14/885,965 Office Action dated Aug. 28, 2018.
U.S. Appl. No. 14/885,965 Office Action dated Aug. 30, 2017.
U.S. Appl. No. 14/885,965 Office Action dated Feb. 10, 2017.
U.S. Appl. No. 14/885,965 Office Action dated Feb. 18, 2016.
U.S. Appl. No. 14/885,965 Office Action dated Jan. 4, 2018.
U.S. Appl. No. 14/885,965 Office Action dated Jul. 7, 2016.
U.S. Appl. No. 15/187,714 Final Office Action dated Sep. 17, 2019.
U.S. Appl. No. 15/187,714 Office Action dated Apr. 4, 2019.
U.S. Appl. No. 15/187,714 Restriction Requirement dated Sep. 17, 2018.
U.S. Appl. No. 15/187,721 Notice of Allowance dated Dec. 7, 2016.
U.S. Appl. No. 15/187,721 Office Action dated Oct. 14, 2016.
U.S. Appl. No. 15/233,835 Notice of Allowance dated Oct. 4, 2017.
U.S. Appl. No. 15/233,835 Office Action dated Feb. 8, 2017.
U.S. Appl. No. 15/233,835 Office Action dated Jul. 26, 2017.
U.S. Appl. No. 15/233,835 Restriction Requirement dated Nov. 4, 2016.
U.S. Appl. No. 15/245,054 Notice of Allowance dated Dec. 14, 2017.
U.S. Appl. No. 15/245,054 Office Action dated Mar. 21, 2017.
U.S. Appl. No. 15/245,054 Office Action dated Oct. 19, 2016.
U.S. Appl. No. 15/377,547 Final Office Action dated Feb. 8, 2019.
U.S. Appl. No. 15/377,547 Office Action dated Jul. 27, 2018.
U.S. Appl. No. 15/377,547 Office Action dated Mar. 24, 2017.
U.S. Appl. No. 15/377,547 Office Action dated Nov. 30, 2017.
U.S. Appl. No. 15/602,991 Final Office Action dated Dec. 13, 2018.
U.S. Appl. No. 15/602,991 Notice of Allowance dated Oct. 25, 2017.
U.S. Appl. No. 15/602,991 Office Action dated May 31, 2018.
U.S. Appl. No. 15/602,991 Office Action dated May 31, 2019.
U.S. Appl. No. 15/602,991 Office Action dated Sep. 21, 2017.
U.S. Appl. No. 15/603,013 Final Office Action dated Nov. 6, 2019.
U.S. Appl. No. 15/603,013 Office Action dated Jan. 30, 2018.
U.S. Appl. No. 15/603,013 Office Action dated Jul. 10, 2018.
U.S. Appl. No. 15/603,013 Office Action dated Jun. 26, 2019.
U.S. Appl. No. 15/603,013 Office Action dated Oct. 20, 2017.
U.S. Appl. No. 15/729,564 Final Office Action dated Dec. 13, 2018.
U.S. Appl. No. 15/729,564 Office Action dated Jan. 8, 2018.
U.S. Appl. No. 15/729,564 Office Action dated Jun. 6, 2018.
U.S. Appl. No. 15/729,564 Office Action dated May 30, 2019.
U.S. Appl. No. 15/991,992 Office Action dated May 21, 2020.
U.S. Appl. No. 15/991,992 Restriction Requirement dated Mar. 10, 2020.
U.S. Appl. No. 16/039,256 Final Office Action dated Mar. 30, 2021.
U.S. Appl. No. 16/039,256 Office Action dated Aug. 20, 2020.
U.S. Appl. No. 16/039,256 Restriction Requirement dated May 18, 2020.
U.S. Appl. No. 16/409,608 Office Action dated Sep. 9, 2019.
U.S. Appl. No. 16/535,777 Final Office Action dated Oct. 20, 2020.
U.S. Appl. No. 16/535,777 Office Action dated Feb. 8, 2021.
U.S. Appl. No. 16/535,777 Office Action dated Jan. 23, 2020.
U.S. Appl. No. 16/535,779 First Action Interview dated Feb. 10, 2020.
Van Tassell et al.: SNP discovery and allele frequency estimation by deep sequencing of reduced representation libraries. Nature Methods. 5:247-252 (2008).
Wang et al.: Antibody Resistance of SARS-CoV-2 Variants B.1.351 and B.1.1.7. Nature. 593(7857):130-135 (2021).
Wang et al.: Structural and Functional Basis of SARS-CoV-2 Entry by Using Human ACE2. Cell. 181:894-904 e9 (2020).
Wrapp et al.: Structural Basis for Potent Neutralization of Betacoronaviruses by Single-Domain Camelid Antibodies. Cell. 181(5):1004-1015 e15 (2020).
Wrobel et al.: Antibody-mediated disruption of the SARS-CoV-2 spike glycoprotein. Nat Commun. 11(1):5337 (2020).
Wu et al.: A new coronavirus associated with human respiratory disease in China. Nature. 579(7798):265-269 (2020).
Wu et al.: Identification of Human Single-Domain Antibodies against SARS-CoV-2. Cell Host Microbe. 27:891-898 e5 (2020).
Wu et al.: Single-Domain Antibodies as Therapeutics against Human Viral Diseases. Front Immunol. 8:1802 (2017).
Xu et al.: Design of 240,000 orthogonal 25mer DNA barcode probes. PNAS. 106(7):2289-2294 (2009).
Yan et al.: Structural basis for the recognition of SARS-CoV-2 by full-length human ACE2. Science. 367(6485):1444-1448 (2020).
Yuan et al.: A highly conserved cryptic epitope in the receptor binding domains of SARS-CoV-2 and SARS-CoV. Science. 368(6491):630-633. Epub (2020).
Yurkovetsky et al.: Structural and Functional Analysis of the D614G SARS-CoV-2 Spike Protein Variant. Cell. 183(3):739-751 e8 (2020).
Zhou et al.: A pneumonia outbreak associated with a new coronavirus of probable bat origin. Nature. 579:270-273 (2020).
Zhu et al.: A Novel Coronavirus from Patients with Pneumonia in China, 2019. N Engl J Med. 382(8):727-733 (2020).
Zost et al.: Potently neutralizing and protective human antibodies against SARS-CoV-2. Nature. 584(7821):443-449 (2020).
Zost et al.: Rapid isolation and profiling of a diverse panel of human monoclonal antibodies targeting the SARS-CoV-2 spike protein. Nat Med. 26:1422-1427 (2020).
Agbavwe et al.: Efficiency, Error and Yield in Light-Directed Maskless Synthesis of DNA Microarrays. Journal of Nanobiotechnology. 9(57):1-17 (2011).
Anonymous: Naming the coronavirus disease (COVID-19) and the virus that causes it. Retrieved from the internet: URL:https://www.who.int/emergencies/diseases/novel-coronavirus-disease-(covid-2019)-and-the-virus-that-causes-it [retrieved on May 18, 2021].
Arvin et al.: A perspective on potential antibody-dependent enhancement of SARS-CoV-2. Nature. 584(7821):353-363 (2020.

(56) References Cited

OTHER PUBLICATIONS

Barnes et al.: Structures of Human Antibodies Bound to SARS-CoV-2 spike Reveal Common Epitopes and Recurrent Features of Antibodies. Cell. 182(4):828-842 (2020).
Corman et al.: Detection of 2019 novel coronavirus (2019-nCoV) by real-time TR-PCR. Euro. Surveillance. 25(3):23-30 (2020).
Kosuri et al.: A scalable gene synthesis by selective amplification of DNA pools from high-fidelity microchips. Nature Biotechnology. 28:1295-1299 (2010).
Meyer et al.: Validation and clinical evaluation of SARS-CoV-2? surrogate virus neutralization test (SVNT). Emerging Microbes & Infections. 9(1):2394-2403 (2020).
Moore et al.: COVID-19 Vaccines: "Warp Speed" Needs Mind Melds, Not Warped Minds. Abstract. Journal of Virology. 94(17):32 pages (2020).
Ng et al.: Substitution at Aspartic Acid 1128 in the SARS Coronavirus Spike Glycoprotein Mediates Escape from a S2 Domain-Targeting Neutralizing Monoclonal Antibody. Plos One. 9(7):e102415 (2014).
Okba et al.: SARS-CoV-2 specific antibody responses in COVID-19 patients. medRxiv reprint doi: https://doi.org/10.1101/2020.03.18.20038059 (2020).
PCT/US2021/017571 International Search Report and Written Opinion dated Jun. 7, 2021.
PCT/US2021/024072 International Search Report and Written Opinion dated Sep. 9, 2021.
PCT/US2021/024164 International Search Report and Written Opinion dated Jun. 22, 2021.
PCT/US2021/024215 International Search Report and Written Opinion dated Jun. 24, 2021.
PCT/US2021/024341 International Search Report and Written Opinion dated Aug. 31, 2021.
PCT/US2021/029485 International Preliminary Report on Patentability dated Nov. 10, 2022.
PCT/US2021/029485 International Search Report and Written Opinion dated Oct. 21, 2021.
PCT/US2021/029485 Invitation to Pay Additional Fees dated Aug. 11, 2021.
PCT/US2021/029486 International Preliminary Report on Patentability dated Nov. 10, 2022.
PCT/US2021/029486 International Search Report and Written Opinion dated Oct. 26, 2021.
PCT/US2021/029486 Invitation to Pay Additional Fees dated Aug. 27, 2021.
Robbiani et al.: Convergent antibody responses to SARS-CoV-2 in convalescent individuals. Nature. 587(7821):437-442 (2020).
Shen et al.: The early cryptic transmission and evolution of SARS-CoV-2 in human hosts. SSRN 3724275 URL:https://www.oyeyeah.com/wp-content/uploads/2020/11/SSRN-id3724275 (2021).
Shibo et al.: An emerging coronavirus causing pneumonia outbreak in Wuhan, China: calling for developing therapeutic and prophylactic strategies. Emerging Microbes & Infections. 9(1):275-277 (2020).
Tomer et al.: Dissecting antibody-mediated protection against SARS-CoV-2. 20(7):392-394 (2020).
UniProKB Accession No. A8ITA5. Predicted protein. URL:https://www.uniprot.org/uniprot/A8ITA5. 1513-1535 (2007).
U.S. Appl. No. 17/242, 179 Restriction Requirement dated Nov. 1, 2022.
U.S. Appl. No. 16/039,256 Office Action dated May 10, 2022.
U.S. Appl. No. 16/737,401 Final Office Action dated Jun. 13, 2022.
U.S. Appl. No. 16/737,401 Office Action dated Jan. 5, 2022.
U.S. Appl. No. 16/737,401 Restriction Requirement dated Nov. 15, 2021.
Wanbo et al.: Characterization of the receptor-binding domain (RBD) of 2019 novel coronavirus: implication for development inhibitor and vaccine. Cellular & Molecular Immunology. 17(6):613-620 (2020).
Wang et al.: A human monoclonal antibody blocking SARS-CoV-2 infection. bioRxiv. DOI:10.1101/2020.03.11.987958 (2020).
Wang et al.: Subunit Vaccines Against Emerging Pathogenic Human Coronaviruses. Frontiers in Microbiology. 11:298 (2020).
Xiaoling et al.: Monoclonal Antibodies Capable of Binding SARS-CoV-2 Spike Protein Receptor Binding Motif Specifically Prevent GM-CSF Induction. bioRxiv. p. 1-27 (2020).
Xiaolong et al.: Potent binding of 2019 novel coronavirus spike protein by a SARS coronavirus-specific human monoclonal antibody. Emerging Microbes & Infections. 9(1):382-385 (2020).
Zhang et al.: Recent advances in the detection of respiratory virus infection in humans. Journal of Medical Virology. 92(4):408-417 (2020).
Zheng et al.: Monoclonal antibodies for the S2 subunit of spike of SARS-CoV-1 cross-react with the newly-emerged SARS-CoV-2. Conclusion. Eurosurveillance. 25(28):1560-7917 (2020).
Zhiqiang et al.: "Conclusion" Monoclonal antibodies for the S2 subunit of spike of SARS-CoV-1 cross-react with the newly-emerged SARSCoV-2. Eurosurveillance. 25(28):1560-7917 (2020).
Zhou et al.: A pneumonia outbreak associated with a new coronavirus of probable bat origin. Nature. Macmillan Journals Ltd., etc., London. 579(7798):270-273 (2020).
Zohar et al.: Dissecting antibody-mediated protection against SARS-CoV-2. Nature Reviews Immunology. 20(7):1474-1733 (2020).
Zost et al.: Rapid isolation and profiling of a diverse panel if human monoclonal antibodies targeting the SARS-CoV-2 spike protein. Nature Medicine. 26(9):1422-1427 (2020).

* cited by examiner

S1, Variant 2-6

S Trimer Variant 2-6

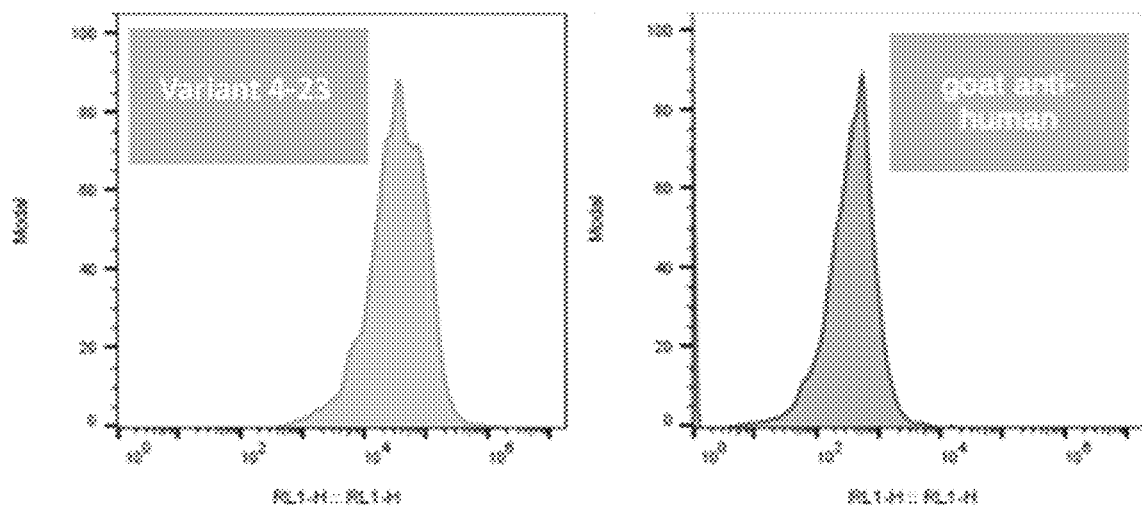
FIG. 14
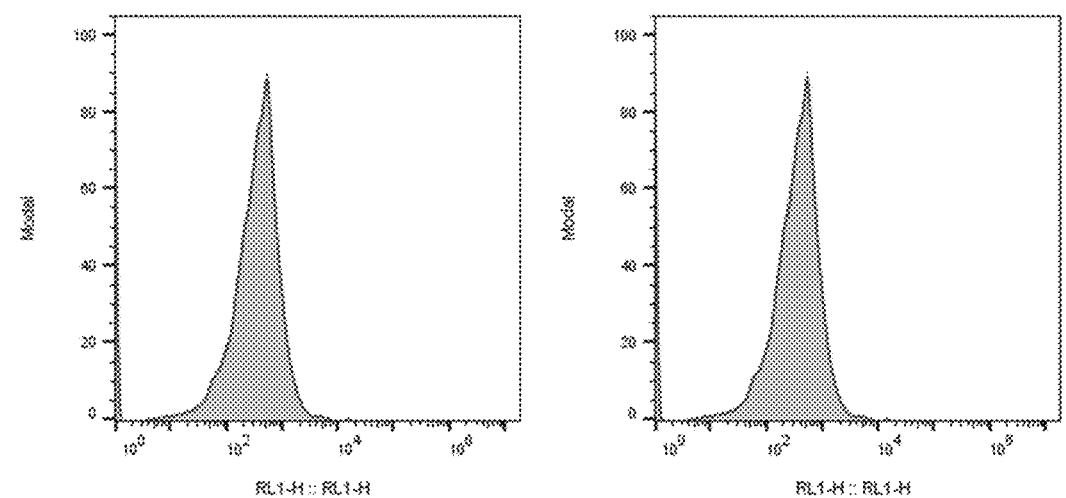
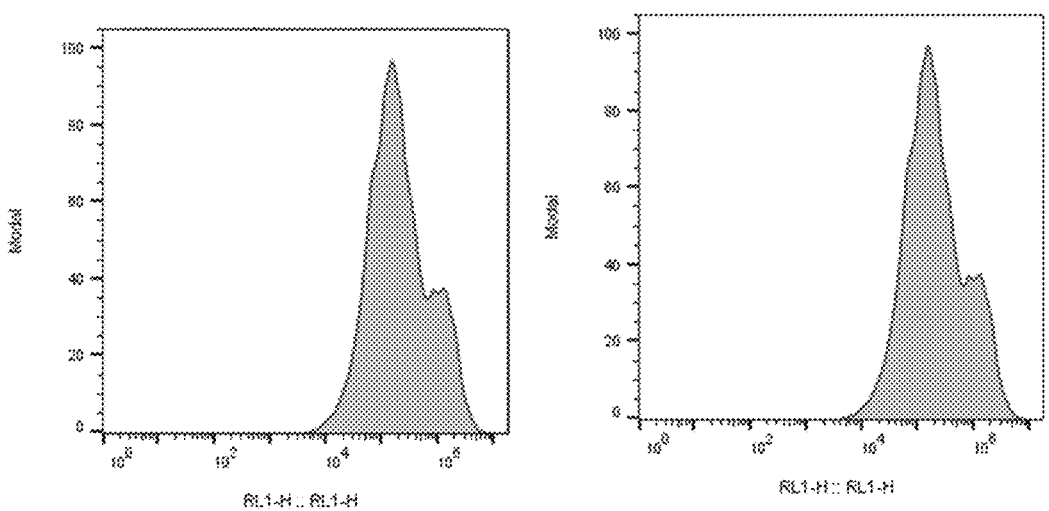
FIG. 15A

| Clone | IC50 (nM) | S1 SPR (nM) | S1 RBD SPR (nM) |
|---|---|---|---|
| 1-32 | 32.2 | 184 | - |
| 2-5 | 2.9 | 0.78 | 0.31 |
| Acro mAb | 4.9 | 48 | 0.1 |

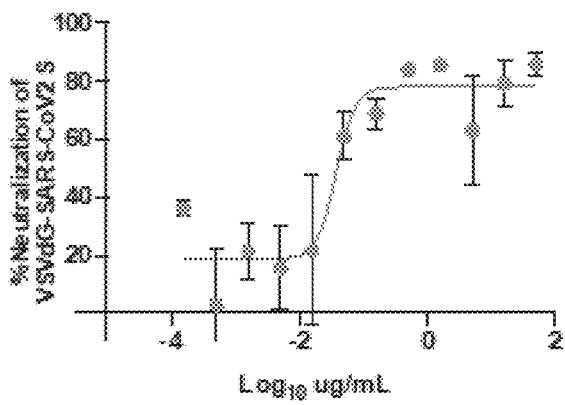
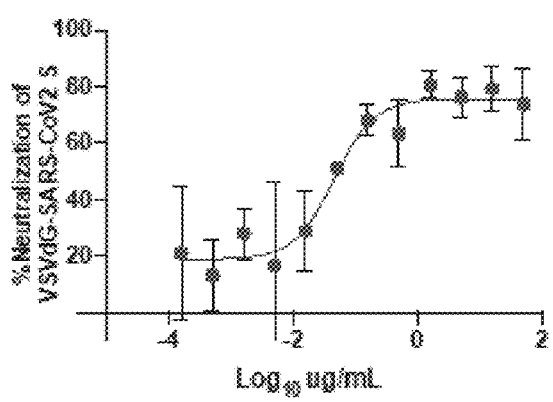
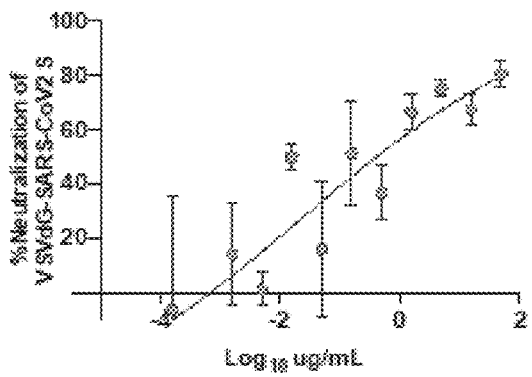
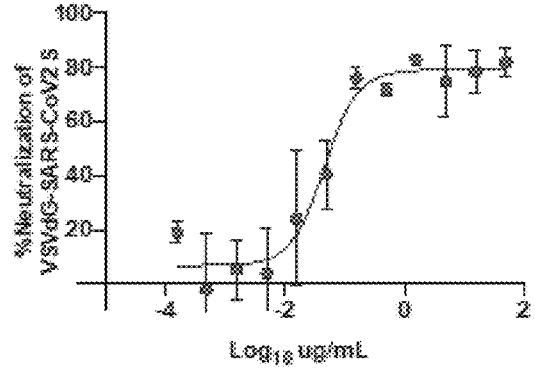
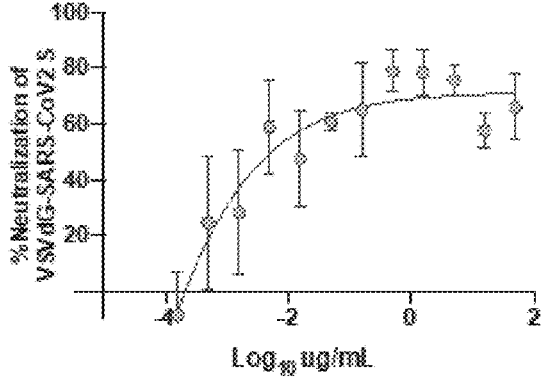
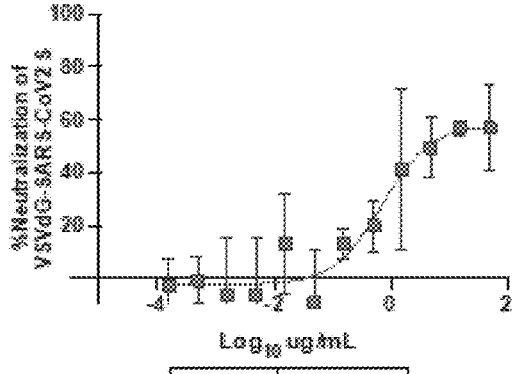
*FIG. 33C*

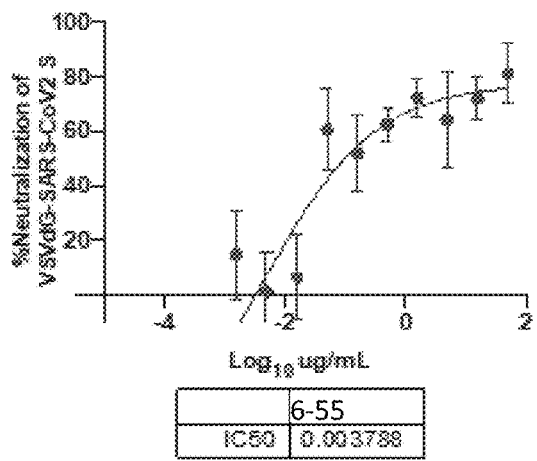
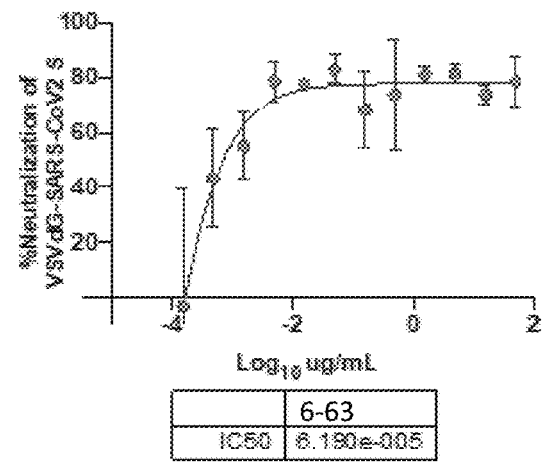
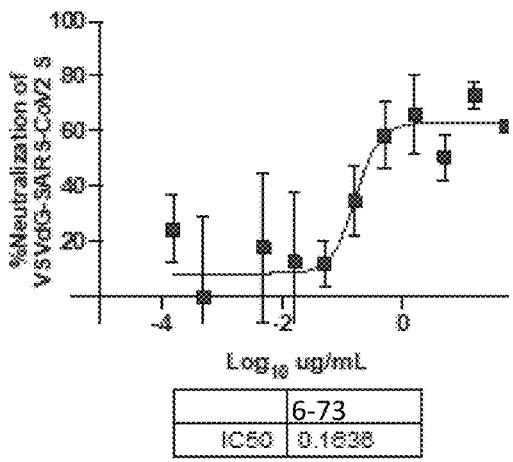
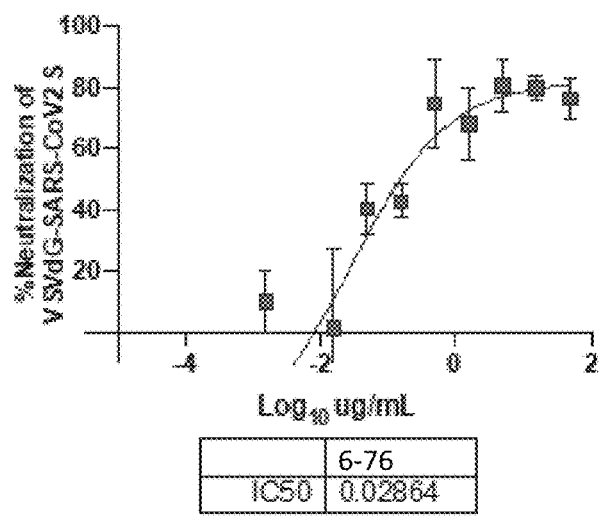
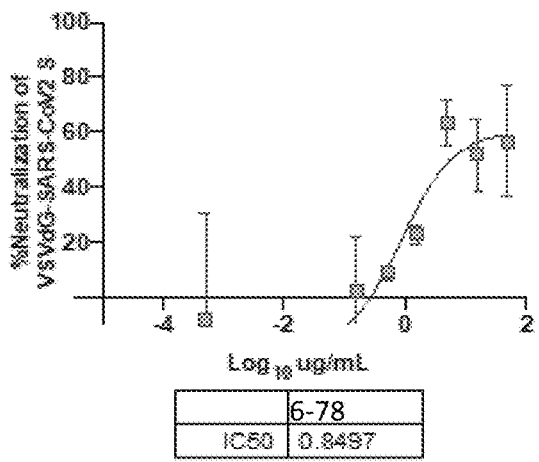
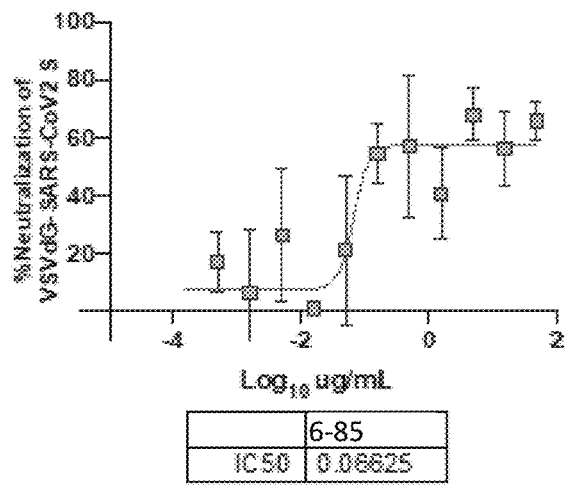
*FIG. 33D*

Sequence of SARS-CoV-2 Membrane glycoprotein construct

MADSNGTITVEELKKLLEQWNLVIGFLFLTWICLLQFAYANRNRFLYIIKLIFLWLLWPVTLACFVLAAVYRINWITGGI
AIAMACLVGLMWLSYFIASFRLFARTRSMWSFNPETNILLNVPLHGTILTRPLLESELVIGAVILRGHLRIAGHHLGR
CDIKDLPKEITVATSRTLSYYKLGASQRVAGDSGFAAYSRYRIGNYKLNTDHSSSSDNIALLVQGLNDIFEAQKIEW
HEGS...GTSVSKGEELFTGVPILVELDGDVNGHKFSVSGEGDATYGKLTLKFICTTGKLPVPWPTL
VTTLTYGVQCFSRYPDHMKQHDFFKSAMPEGYVQERTIFFKDDGNYKTRAEVKFEGDTLVNRIEKGIDFKEDGN
ILGHKLEYNYNSHNVYIMADKQKNGIKVNFKIRHNIEDGSVQLADHYQQNTPIGDGPVLLPDNHYLSTQSKLSKDP
NEKRDHMVLLEFVTAAGITLGMDELYKHHHHHH

Avi tag
GFP
His tag

FIG. 35

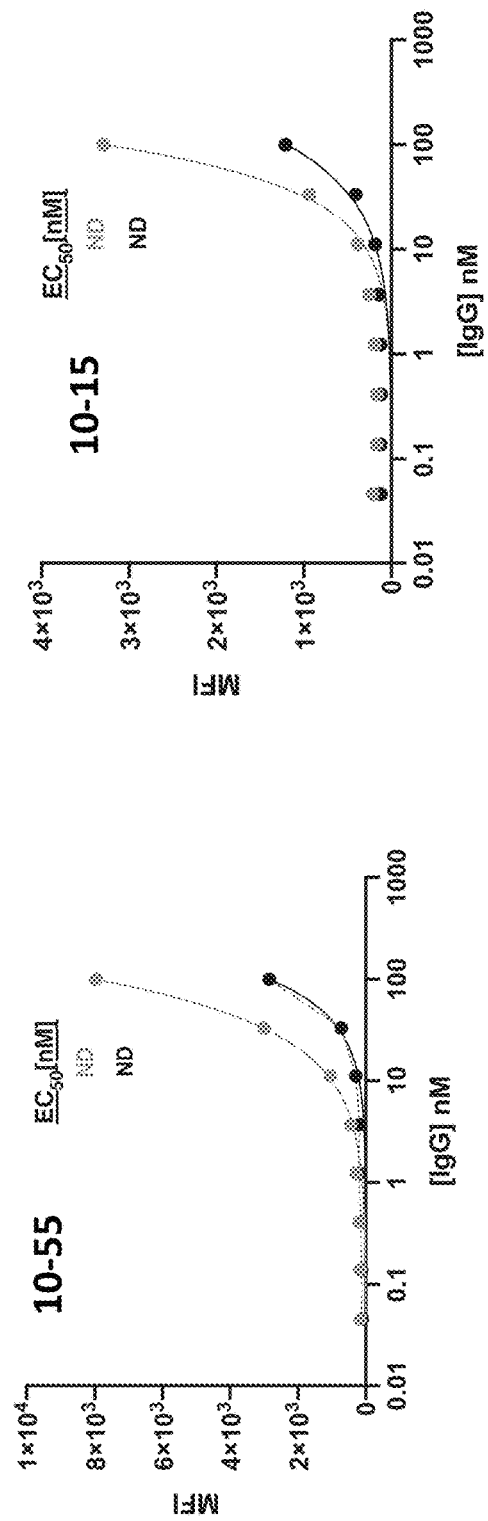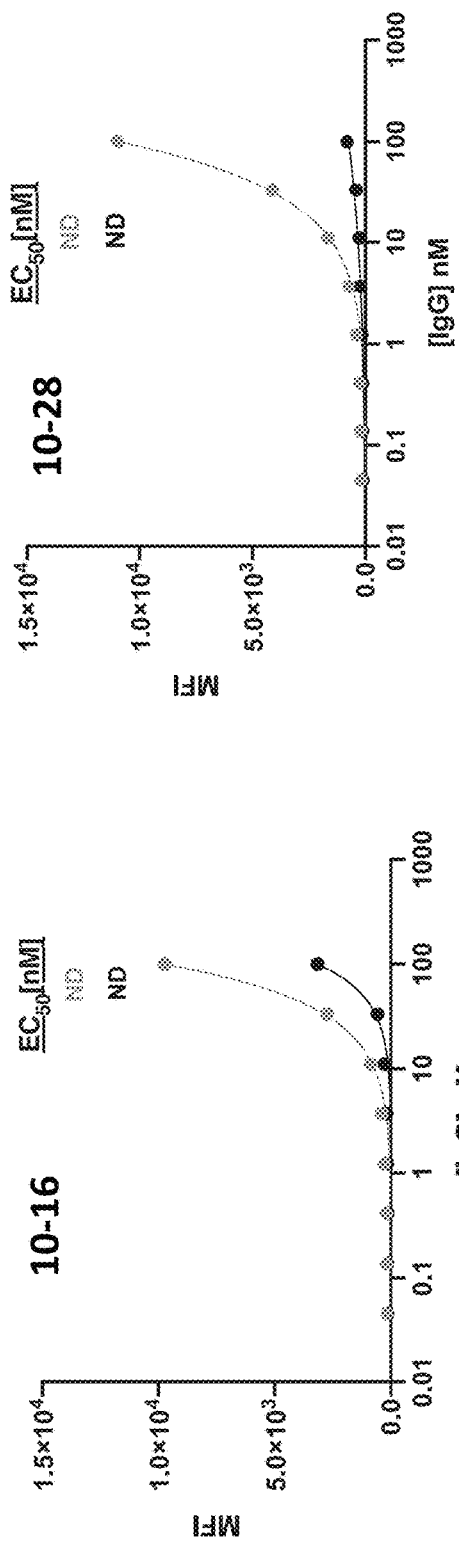

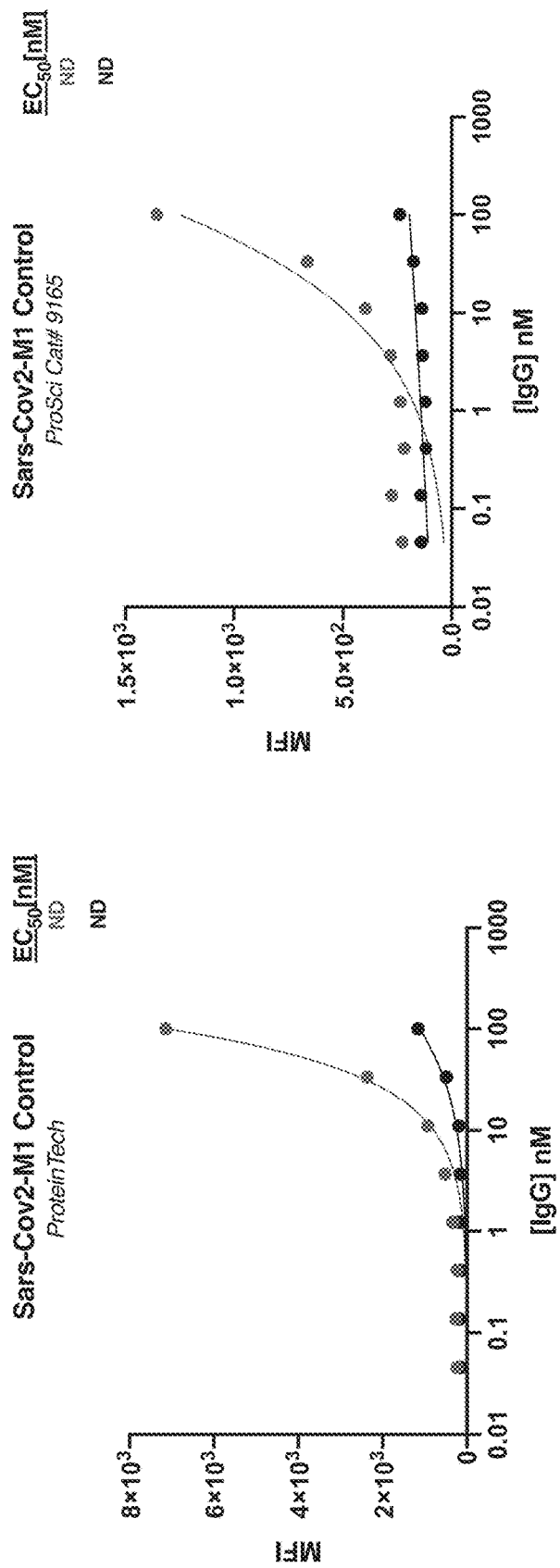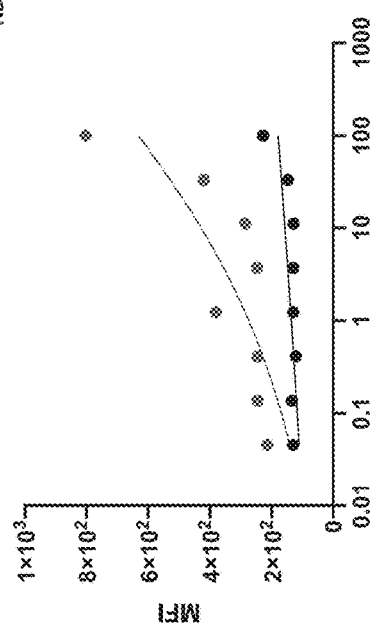
FIG. 38H
FIG. 38I
FIG. 38J

VSV-SARS-CoV-2 D614G

*FIG. 42A*

VSV-SARS-CoV-2 D614G

VARIANT NUCLEIC ACID LIBRARIES FOR CORONAVIRUS

CROSS-REFERENCE

This application claims the benefit of U.S. Provisional Patent Application No. 63/115,568 filed on Nov. 18, 2020, U.S. Provisional Patent Application No. 63/104,465 filed on Oct. 22, 2020, U.S. Provisional Patent Application No. 63/073,362 filed on Sep. 1, 2020, U.S. Provisional Patent Application No. 63/069,665 filed on Aug. 24, 2020, U.S. Provisional Patent Application No. 63/034,896 filed on Jun. 4, 2020, U.S. Provisional Patent Application No. 63/016,254 filed on Apr. 27, 2020, each of which is incorporated by reference in its entirety.

SEQUENCE LISTING

The instant application contains a Sequence Listing which has been submitted electronically in ASCII format and is hereby incorporated by reference in its entirety. Said ASCII copy, created on May 28, 2021, is named 44854-804_201_SL.txt and is 1,428,806 bytes in size.

BACKGROUND

Coronaviruses like severe acute respiratory coronavirus 2 (SARS-CoV-2) can cause severe respiratory problems. Therapies are needed for treating and preventing viral infection caused by coronaviruses like SARS-CoV-2. Antibodies possess the capability to bind with high specificity and affinity to biological targets. However, the design of therapeutic antibodies is challenging due to balancing of immunological effects with efficacy. Thus, there is a need to develop compositions and methods for the optimization of antibody properties in order to develop effective therapies for treating coronavirus infections.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF SUMMARY

Provided herein are nucleic acid libraries comprising: a plurality of sequences that when translated encode for antibodies or antibody fragments that bind to SARS-CoV-2 or ACE2 protein, wherein each of the sequences comprises a predetermined number of variants within a CDR relative to an input sequence that encodes an antibody, and wherein the library comprises at least 50,000 variant sequences. Further provided herein are nucleic acid libraries, wherein the antibodies or antibody fragments bind to a spike glycoprotein, a membrane protein, an envelope protein, a nucleocapsid protein, or combinations thereof of the SARS-CoV-2. Further provided herein are nucleic acid libraries, wherein the antibodies or antibody fragments bind to a spike glycoprotein. Further provided herein are nucleic acid libraries, wherein the antibodies or antibody fragment bind to a receptor binding domain of the spike glycoprotein. Further provided herein are nucleic acid libraries, wherein the library comprises at least 100,000 variant sequences. Further provided herein are nucleic acid libraries, wherein at least some of the sequences encode for an antibody light chain. Further provided herein are nucleic acid libraries, wherein at least some of the sequences encode for an antibody heavy chain. Further provided herein are nucleic acid libraries, wherein each sequence of the plurality of sequences comprises at least one variant in the CDR of a heavy chain or light chain relative to the input sequence. Further provided herein are nucleic acid libraries, wherein each sequence of the plurality of sequences comprises at least two variants in the CDR of a heavy chain or light chain relative to the input sequence. Further provided herein are nucleic acid libraries, wherein at least one of the variants is present in at least two individuals. Further provided herein are nucleic acid libraries, wherein at least one of the variants is present in at least three individuals. Further provided herein are nucleic acid libraries, wherein at least one sequence when translated encodes for an antibody or antibody fragment having at least 5× higher binding affinity than a binding affinity of the input sequence. Further provided herein are nucleic acid libraries, wherein at least one sequence when translated encodes for an antibody or antibody fragment having at least 25× higher binding affinity than a binding affinity of the input sequence. Further provided herein are nucleic acid libraries, wherein at least one sequence when translated encodes for an antibody or antibody fragment having at least 50× higher binding affinity than a binding affinity of the input sequence. Further provided herein are nucleic acid libraries, wherein each sequence of the plurality of sequences comprises at least one variant in the CDR of a heavy chain or light chain relative to a germline sequence of the input sequence. Further provided herein are nucleic acid libraries, wherein the CDR is a CDR1, CDR2, and CDR3 on a heavy chain. Further provided herein are nucleic acid libraries, wherein the CDR is a CDR1, CDR2, and CDR3 on a light chain. Further provided herein are nucleic acid libraries, wherein the at least one sequence that when translated encodes for an antibody or antibody fragment having at least 70× higher binding affinity than the input sequence. Further provided herein are nucleic acid libraries, wherein the at least one sequence that when translated encodes for an antibody or antibody fragment having a $K_D$ of less than 50 nM. Further provided herein are nucleic acid libraries, wherein the at least one sequence that when translated encodes for an antibody or antibody fragment having a $K_D$ of less than 25 nM. Further provided herein are nucleic acid libraries, wherein the at least one sequence that when translated encodes for an antibody or antibody fragment having a $K_D$ of less than 10 nM. Further provided herein are nucleic acid libraries, wherein the at least one sequence that when translated encodes for an antibody or antibody fragment having a $K_D$ of less than 5 nM. Further provided herein are nucleic acid libraries, wherein the library encodes a CDR sequence of any one of SEQ ID NOs: 1-921, 1047-1208, 1263-1436, 1495-1917, or 2059-2598.

Provided herein are nucleic acid libraries comprising: a plurality of sequences that when translated encode for antibodies or antibody fragments that bind to a coronavirus or a receptor of the coronavirus, wherein each of the sequences comprises a predetermined number of variants within a CDR relative to an input sequence that encodes an antibody, and wherein the library comprises at least 50,000 variant sequences. Further provided herein are nucleic acid libraries, wherein the coronavirus is SARS-CoV, MERS-CoV, CoV-229E, HCoV-NL63, HCoV-OC43, or HCoV-HKU1. Further provided herein are nucleic acid libraries, wherein the receptor of the coronavirus is ACE2 or dipeptidyl peptidase 4 (DPP4). Further provided herein are nucleic acid libraries, wherein the library comprises at least 100,000 variant sequences. Further provided herein are nucleic acid libraries, wherein at least some of the sequences encode for an antibody light chain. Further provided herein are nucleic acid libraries, wherein at least some of the sequences encode for an antibody heavy chain. Further provided herein are nucleic acid libraries, wherein each sequence of the plurality of sequences comprises at least one variant in the CDR of a heavy chain or light chain relative to the input sequence. Further provided herein are nucleic acid libraries, wherein each sequence of the plurality of sequences comprises at least two variants in the CDR of a heavy chain or light chain relative to the input sequence. Further provided herein are nucleic acid libraries, wherein at least one of the variants is present in at least two individuals. Further provided herein are nucleic acid libraries, wherein at least one of the variants is present in at least three individuals. Further provided herein are nucleic acid libraries, wherein at least one sequence when translated encodes for an antibody or antibody fragment having at least 5× higher binding affinity than a binding affinity of the input sequence. Further provided herein are nucleic acid libraries, wherein at least one sequence when translated encodes for an antibody or antibody fragment having at least 25× higher binding affinity than a binding affinity of the input sequence. Further provided herein are nucleic acid libraries, wherein at least one sequence when translated encodes for an antibody or antibody fragment having at least 50× higher binding affinity than a binding affinity of the input sequence. Further provided herein are nucleic acid libraries, wherein each sequence of the plurality of sequences comprises at least one variant in the CDR of a heavy chain or light chain relative to a germline sequence of the input sequence. Further provided herein are nucleic acid libraries, wherein the CDR is a CDR1, CDR2, and CDR3 on a heavy chain. Further provided herein are nucleic acid libraries, wherein the CDR is a CDR1, CDR2, and CDR3 on a light chain. Further provided herein are nucleic acid libraries, wherein the at least one sequence that when translated encodes for an antibody or antibody fragment having at least 70× higher binding affinity than the input sequence. Further provided herein are nucleic acid libraries, wherein the at least one sequence that when translated encodes for an antibody or antibody fragment having a $K_D$ of less than 50 nM. Further provided herein are nucleic acid libraries, wherein the at least one sequence that when translated encodes for an antibody or antibody fragment having a $K_D$ of less than 25 nM. Further provided herein are nucleic acid libraries, wherein the at least one sequence that when translated encodes for an antibody or antibody fragment having a $K_D$ of less than 10 nM. Further provided herein are nucleic acid libraries, wherein the at least one sequence that when translated encodes for an antibody or antibody fragment having a $K_D$ of less than 5 nM.

Provided herein are antibodies, wherein the antibody comprises a sequence comprising at least 90% sequence identity to any one of SEQ ID NOs: 1-2668.

Provided herein are antibodies, wherein the antibody comprises a sequence comprising at least 90% sequence identity to SEQ ID NOs: 1-2668; and wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof.

Provided herein are methods of treating a SARS-CoV-2 infection, comprising administering the antibody as described herein. Further provided herein are methods, wherein the antibody is administered prior to exposure to SARS-CoV-2. Further provided herein are methods, wherein the antibody is administered at least about 1 week prior to exposure to SARS-CoV-2. Further provided herein are methods, wherein the antibody is administered at least about 1 month prior to exposure to SARS-CoV-2. Further provided herein are methods, wherein the antibody is administered at least about 5 months prior to exposure to SARS-CoV-2. Further provided herein are methods, wherein the antibody is administered after exposure to SARS-CoV-2. Further provided herein are methods, wherein the antibody is administered at most about 24 hours after exposure to SARS-CoV-2. Further provided herein are methods, wherein the antibody is administered at most about 1 week after exposure to SARS-CoV-2. Further provided herein are methods, wherein the antibody is administered at most about 1 month after exposure to SARS-CoV-2.

Provided herein are methods of treating an individual with a SARS-CoV-2 infection with the antibody as described herein comprising: (a) obtaining or having obtained a sample from the individual; (b) performing or having performed an expression level assay on the sample to determine expression levels of SARS-CoV-2 antibodies; and (c) if the sample has an expression level of the SARS-CoV-2 antibodies then administering to the individual the antibody as described herein, thereby treating the SARS-CoV-2 infection.

Provided herein are methods for optimizing an antibody comprising: (a) providing a plurality of polynucleotide sequences encoding for an antibody or antibody fragment, wherein the antibody or antibody fragment is derived from a subject having SARS-CoV-2; (b) generating a nucleic acid library comprising the plurality of sequences that when translated encode for antibodies or antibody fragments that bind SARS-CoV-2 or ACE2 protein, wherein each of the sequences comprises a predetermined number of variants within a CDR relative to an input sequence that encodes an antibody; wherein the library comprises at least 50,000 variant sequences; and (c) synthesizing the at least 50,000 variant sequences. Further provided herein are methods, wherein the antibody library comprises at least 100,000 sequences. Further provided herein are methods, wherein the method further comprises enriching a subset of the variant sequences. Further provided herein are methods, wherein the method further comprises expressing the antibody or antibody fragments corresponding to the variant sequences. Further provided herein are methods, wherein the polynucleotide sequence is a murine, human, or chimeric antibody sequence. Further provided herein are methods, wherein each sequence of the plurality of variant sequences comprises at least one variant in each CDR of a heavy chain or light chain, relative to the input sequence. Further provided herein are methods, wherein each sequence of the plurality of variant sequences comprises at least two variants in each CDR of a heavy chain or light chain relative to the input sequence. Further provided herein are methods, wherein at least one sequence when translated encodes for an antibody or antibody fragment having at least 5× higher binding affinity than a binding affinity of the input sequence. Further provided herein are methods, wherein at least one sequence when translated encodes for an antibody or antibody fragment having at least 25× higher binding affinity than a binding affinity of the input sequence. Further provided herein are methods, wherein at least one sequence when translated encodes for an antibody or antibody fragment having at least 50× higher binding affinity than a binding affinity of the input sequence. Further provided herein are methods, wherein each sequence comprises at least one variant in each CDR of a heavy chain or light chain relative to a germline sequence of the input sequence. Further provided herein are methods, wherein the nucleic acid library has a theoretical diversity of at least $10^{10}$ sequences. Further provided herein are methods, wherein the nucleic acid library has a theoretical diversity of at least $10^{12}$ sequences.

Provided herein are antibodies or antibody fragments comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 151-165, 241-255, 331-357, and 547-575; (b) an amino acid sequence of CDRH2 is as set forth in any one of SEQ ID NOs: 166-180, 256-270, 358-384, and 576-604; (c) an amino acid sequence of CDRH3 is as set forth in any one of SEQ ID NOs: 181-195, 271-285, 385-411, and 605-633; (d) an amino acid sequence of CDRL1 is as set forth in any one of SEQ ID NOs: 196-210, 286-300, 412-438, and 634-662; (e) an amino acid sequence of CDRL2 is as set forth in any one of SEQ ID NOs: 211-225, 301-315, 439-465, and 663-691; and (f) an amino acid sequence of CDRL3 is as set forth in any one of SEQ ID NOs: 226-240, 316-330, 466-492, and 692-720. Further provided herein are antibodies or antibody fragments, wherein (a) an amino acid sequence of CDRH1 is as set forth in SEQ ID NO: 155; (b) an amino acid sequence of CDRH2 is as set forth in SEQ ID NO: 170; (c) an amino acid sequence of CDRH3 is as set forth in SEQ ID NO: 185; (d) an amino acid sequence of CDRL1 is as set forth in SEQ ID NO: 200; (e) an amino acid sequence of CDRL2 is as set forth in SEQ ID NO: 215; and (f) an amino acid sequence of CDRL3 is as set forth in SEQ ID NO: 230. Further provided herein are antibodies or antibody fragments, wherein (a) an amino acid sequence of CDRH1 is as set forth in SEQ ID NO: 152; (b) an amino acid sequence of CDRH2 is as set forth in SEQ ID NO: 167; (c) an amino acid sequence of CDRH3 is as set forth in SEQ ID NO: 182; (d) an amino acid sequence of CDRL1 is as set forth in SEQ ID NO: 197; (e) an amino acid sequence of CDRL2 is as set forth in SEQ ID NO: 212; and (f) an amino acid sequence of CDRL3 is as set forth in SEQ ID NO: 227. Further provided herein are antibodies or antibody fragments, wherein (a) an amino acid sequence of CDRH1 is as set forth in SEQ ID NO: 335; (b) an amino acid sequence of CDRH2 is as set forth in SEQ ID NO: 362; (c) an amino acid sequence of CDRH3 is as set forth in SEQ ID NO: 389; (d) an amino acid sequence of CDRL1 is as set forth in SEQ ID NO: 199; (e) an amino acid sequence of CDRL2 is as set forth in SEQ ID NO: 214; and (f) an amino acid sequence of CDRL3 is as set forth in SEQ ID NO: 229. Further provided herein are antibodies or antibody fragments, wherein (a) an amino acid sequence of CDRH1 is as set forth in SEQ ID NO: 336; (b) an amino acid sequence of CDRH2 is as set forth in SEQ ID NO: 363; (c) an amino acid sequence of CDRH3 is as set forth in SEQ ID NO: 390; (d) an amino acid sequence of CDRL1 is as set forth in SEQ ID NO: 201; (e) an amino acid sequence of CDRL2 is as set forth in SEQ ID NO: 216; and (f) an amino acid sequence of CDRL3 is as set forth in SEQ ID NO: 231. Further provided herein are antibodies or antibody fragments, wherein (a) an amino acid sequence of CDRH1 is as set forth in SEQ ID NO: 158; (b) an amino acid sequence of CDRH2 is as set forth in SEQ ID NO: 173; (c) an amino acid sequence of CDRH3 is as set forth in SEQ ID NO: 188; (d) an amino acid sequence of CDRL1 is as set forth in SEQ ID NO: 203; (e) an amino acid sequence of CDRL2 is as set forth in SEQ ID NO: 218; and (f) an amino acid sequence of CDRL3 is as set forth in SEQ ID NO: 233. Further provided herein are antibodies or antibody fragments, wherein (a) an amino acid sequence of CDRH1 is as set forth in SEQ ID NO: 551; (b) an amino acid sequence of CDRH2 is as set forth in SEQ ID NO: 580; (c) an amino acid sequence of CDRH3 is as set forth in SEQ ID NO: 609; (d) an amino acid sequence of CDRL1 is as set forth in SEQ ID NO: 290; (e) an amino acid sequence of CDRL2 is as set forth in SEQ ID NO: 305; and (f) an amino acid sequence of CDRL3 is as set forth in SEQ ID NO: 320. Further provided herein are antibodies or antibody fragments, wherein (a) an amino acid sequence of CDRH1 is as set forth in SEQ ID NO: 549; (b) an amino acid sequence of CDRH2 is as set forth in SEQ ID NO: 578; (c) an amino acid sequence of CDRH3 is as set forth in SEQ ID NO: 607; (d) an amino acid sequence of CDRL1 is as set forth in SEQ ID NO: 292; (e) an amino acid sequence of CDRL2 is as set forth in SEQ ID NO: 307; and (f) an amino acid sequence of CDRL3 is as set forth in SEQ ID NO: 322. Further provided herein are antibodies or antibody fragments, wherein (a) an amino acid sequence of CDRH1 is as set forth in SEQ ID NO: 552; (b) an amino acid sequence of CDRH2 is as set forth in SEQ ID NO: 581; (c) an amino acid sequence of CDRH3 is as set forth in SEQ ID NO: 610; (d) an amino acid sequence of CDRL1 is as set forth in SEQ ID NO: 291; (e) an amino acid sequence of CDRL2 is as set forth in SEQ ID NO: 306; and (f) an amino acid sequence of CDRL3 is as set forth in SEQ ID NO: 321. Further provided herein are antibodies or antibody fragments, wherein (a) an amino acid sequence of CDRH1 is as set forth in SEQ ID NO: 554; (b) an amino acid sequence of CDRH2 is as set forth in SEQ ID NO: 583; (c) an amino acid sequence of CDRH3 is as set forth in SEQ ID NO: 612; (d) an amino acid sequence of CDRL1 is as set forth in SEQ ID NO: 288; (e) an amino acid sequence of CDRL2 is as set forth in SEQ ID NO: 303; and (f) an amino acid sequence of CDRL3 is as set forth in SEQ ID NO: 318. Further provided herein are antibodies or antibody fragments, wherein the antibody or antibody fragment binds to a spike glycoprotein. Further provided herein are antibodies or antibody fragments, wherein the antibody or antibody fragment binds to a receptor binding domain of the spike glycoprotein. Further provided herein are antibodies or antibody fragments, wherein the antibody or antibody fragment comprises a $K_D$ of less than 50 nM. Further provided herein are antibodies or antibody fragments, wherein the antibody or antibody fragment comprises a $K_D$ of less than 25 nM. Further provided herein are antibodies or antibody fragments, wherein the antibody or antibody fragment comprises a $K_D$ of less than 10 nM. Further provided herein are antibodies or antibody fragments, wherein the antibody or antibody fragment comprises a $K_D$ of less than 5 nM.

Provided herein are antibodies or antibody fragments comprising a variable domain, heavy chain region (VH) wherein VH comprises complementarity determining regions CDRH1, CDRH2, and CDRH3, wherein (a) an amino acid sequence of CDRH1 is as set forth in any one of SEQ ID NOs: 1-50, 779-919, 1344-1523, and 2381-2452; (b) an amino acid sequence of CDRH2 is as set forth in any one of SEQ ID NOs: 51-100, 920-1061, 1524-1703, and 2453-2524; and (c) an amino acid sequence of CDRH3 is as set forth in any one of SEQ ID NOs: 101-150, 1062-1202, 1704-1883, and 2525-2596. Further provided herein are antibodies or antibody fragments, wherein (a) the amino acid sequence of CDRH1 is as set forth in SEQ ID NO: 1414; (b) the amino acid sequence of CDRH2 is as set forth in SEQ ID NO: 1594; and (c) the amino acid sequence of CDRH3 is as set forth in SEQ ID NO: 1774. Further provided herein are antibodies or antibody fragments, wherein (a) the amino acid sequence of CDRH1 is as set forth in SEQ ID NO: 1447; (b) the amino acid sequence of CDRH2 is as set forth in SEQ ID NO: 1627; and (c) the amino acid sequence of CDRH3 is as set forth in SEQ ID NO: 1807. Further provided herein are antibodies or antibody fragments, wherein (a) the amino acid sequence of CDRH1 is as set forth in SEQ ID NO: 1474; (b) the amino acid sequence of CDRH2 is as set forth in SEQ ID NO: 1654; and (c) the amino acid sequence of CDRH3 is as set forth in SEQ ID NO: 1834. Further provided herein are antibodies or antibody fragments, wherein (a) the amino acid sequence of CDRH1 is as set forth in SEQ ID NO: 1344; (b) the amino acid sequence of CDRH2 is as set forth in SEQ ID NO: 1524; and (c) the amino acid sequence of CDRH3 is as set forth in SEQ ID NO: 1704. Further provided herein are antibodies or antibody fragments, wherein (a) the amino acid sequence of CDRH1 is as set forth in SEQ ID NO: 1363; (b) the amino acid sequence of CDRH2 is as set forth in SEQ ID NO: 1543; and (c) the amino acid sequence of CDRH3 is as set forth in SEQ ID NO: 1723. Further provided herein are antibodies or antibody fragments, wherein (a) the amino acid sequence of CDRH1 is as set forth in SEQ ID NO: 1487; (b) the amino acid sequence of CDRH2 is as set forth in SEQ ID NO: 1667; and (c) the amino acid sequence of CDRH3 is as set forth in SEQ ID NO: 1847. Further provided herein are antibodies or antibody fragments, wherein (a) the amino acid sequence of CDRH1 is as set forth in SEQ ID NO: 780; (b) the amino acid sequence of CDRH2 is as set forth in SEQ ID NO: 921; and (c) the amino acid sequence of CDRH3 is as set forth in SEQ ID NO: 1063. Further provided herein are antibodies or antibody fragments, wherein (a) the amino acid sequence of CDRH1 is as set forth in SEQ ID NO: 782; (b) the amino acid sequence of CDRH2 is as set forth in SEQ ID NO: 923; and (c) the amino acid sequence of CDRH3 is as set forth in SEQ ID NO: 1065. Further provided herein are antibodies or antibody fragments, wherein (a) the amino acid sequence of CDRH1 is as set forth in SEQ ID NO: 39; (b) the amino acid sequence of CDRH2 is as set forth in SEQ ID NO: 89; and (c) the amino acid sequence of CDRH3 is as set forth in SEQ ID NO: 139. Further provided herein are antibodies or antibody fragments, wherein (a) the amino acid sequence of CDRH1 is as set forth in SEQ ID NO: 832; (b) the amino acid sequence of CDRH2 is as set forth in SEQ ID NO: 973; and (c) the amino acid sequence of CDRH3 is as set forth in SEQ ID NO: 1115. Further provided herein are antibodies or antibody fragments, wherein (a) the amino acid sequence of CDRH1 is as set forth in SEQ ID NO: 869; (b) the amino acid sequence of CDRH2 is as set forth in SEQ ID NO: 1010; and (c) the amino acid sequence of CDRH3 is as set forth in SEQ ID NO: 1152. Further provided herein are antibodies or antibody fragments, wherein (a) the amino acid sequence of CDRH1 is as set forth in SEQ ID NO: 889; (b) the amino acid sequence of CDRH2 is as set forth in SEQ ID NO: 1030; and (c) the amino acid sequence of CDRH3 is as set forth in SEQ ID NO: 1172. Further provided herein are antibodies or antibody fragments, wherein (a) the amino acid sequence of CDRH1 is as set forth in SEQ ID NO: 908; (b) the amino acid sequence of CDRH2 is as set forth in SEQ ID NO: 1049; and (c) the amino acid sequence of CDRH3 is as set forth in SEQ ID NO: 1191.

Provided herein are antibodies or antibody fragments comprising a variable domain, heavy chain region (VH) and a variable domain, light chain region (VL), wherein the VH comprises an amino acid sequence at least about 90% identical to a sequence as set forth in any one of SEQ ID NOs: 493-519 and 721-749, and wherein the VL comprises an amino acid sequence at least about 90% identical to a sequence as set forth in any one of SEQ ID NOs: 520-546 and 750-778.

Provided herein are antibodies or antibody fragments comprising a variable domain, heavy chain region (VH) comprising an amino acid sequence at least about 90% identical to a sequence as set forth in any one of SEQ ID NOs: 1884-2063, 2302-2380, and 2597-2668. Further provided herein are antibodies or antibody fragments, wherein the VH comprises an amino acid sequence at least about 90% identical to SEQ ID NO: 1954. Further provided herein are antibodies or antibody fragments, wherein the VH comprises an amino acid sequence at least about 90% identical to SEQ ID NO: 1987. Further provided herein are antibodies or antibody fragments, wherein the VH comprises an amino acid sequence at least about 90% identical to SEQ ID NO: 2014.

Provided herein are antibodies, wherein the antibody comprises a sequence comprising at least 90% sequence identity to any one of SEQ ID NOs: 1-2668; and wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof.

Provided herein are nucleic acid compositions comprising: a) a first nucleic acid encoding a variable domain, heavy chain region (VH) comprising an amino acid sequence at least about 90% identical to a sequence as set forth in any one of SEQ ID NOs: 493-519 and 721-749; b) a second nucleic acid encoding a variable domain, light chain region (VL) comprising at least about 90% identical to a sequence as set forth in any one of SEQ ID NOs: 520-546 and 750-778; and an excipient.

Provided herein are nucleic acid compositions comprising: a) a first nucleic acid encoding a variable domain, heavy chain region (VH) comprising an amino acid sequence at least about 90% identical to a sequence as set forth in any one of SEQ ID NOs: 1884-2063, 2302-2380, and 2597-2668; and b) an excipient. Further provided herein are nucleic acid compositions, wherein the VH comprises an amino acid sequence at least about 90% identical to SEQ ID NO: 1954. Further provided herein are nucleic acid compositions, wherein the VH comprises an amino acid sequence at least about 90% identical to SEQ ID NO: 1987. Further provided herein are nucleic acid compositions, wherein the VH comprises an amino acid sequence at least about 90% identical to SEQ ID NO: 2014.

Provided herein are methods of treating a SARS-CoV-2 infection, comprising administering the antibody or antibody fragment described herein. Further provided herein are methods, wherein the antibody is administered prior to exposure to SARS-CoV-2. Further provided herein are methods, wherein the antibody is administered at least about 1 week prior to exposure to SARS-CoV-2. Further provided herein are methods, wherein the antibody is administered at least about 1 month prior to exposure to SARS-CoV-2. Further provided herein are methods, wherein the antibody is administered at least about 5 months prior to exposure to SARS-CoV-2. Further provided herein are methods, wherein the antibody is administered after exposure to SARS-CoV-2. Further provided herein are methods, wherein the antibody is administered at most about 24 hours after exposure to SARS-CoV-2. Further provided herein are methods, wherein the antibody is administered at most about 1 week after exposure to SARS-CoV-2. Further provided herein are methods, wherein the antibody is administered at most about 1 month after exposure to SARS-CoV-2. Further provided herein are methods of treating an individual with a SARS-CoV-2 infection with the antibody or antibody fragment described herein comprising: a) obtaining or having obtained a sample from the individual; b) performing or having performed an expression level assay on the sample to determine expression levels of SARS-CoV-2 antibodies; and if the sample has an expression level of the SARS-CoV-2 antibodies then administering to the individual the antibody or antibody fragment described herein, thereby treating the SARS-CoV-2 infection. Further provided herein are methods for optimizing an antibody comprising: a) providing a plurality of polynucleotide sequences encoding for an antibody or antibody fragment, wherein the antibody or antibody fragment is derived from a subject having SARS-CoV-2; b) generating a nucleic acid library comprising the plurality of sequences that when translated encode for antibodies or antibody fragments that bind SARS-CoV-2 or ACE2 protein, wherein each of the sequences comprises a predetermined number of variants within a CDR relative to an input sequence that encodes an antibody; wherein the library comprises at least 50,000 variant sequences; and c) synthesizing the at least 50,000 variant sequences. Further provided herein are methods, wherein the antibody library comprises at least 100,000 sequences. Further provided herein are methods, wherein the method further comprises enriching a subset of the variant sequences. Further provided herein are methods, wherein the method further comprises expressing the antibody or antibody fragments corresponding to the variant sequences. Further provided herein are methods, wherein the polynucleotide sequence is a murine, human, or chimeric antibody sequence. Further provided herein are methods, wherein each sequence of the plurality of variant sequences comprises at least one variant in each CDR of a heavy chain or light chain, relative to the input sequence. Further provided herein are methods, wherein each sequence of the plurality of variant sequences comprises at least two variants in each CDR of a heavy chain or light chain relative to the input sequence. Further provided herein are methods, wherein at least one sequence when translated encodes for an antibody or antibody fragment having at least 5× higher binding affinity than a binding affinity of the input sequence. Further provided herein are methods, wherein at least one sequence when translated encodes for an antibody or antibody fragment having at least 25× higher binding affinity than a binding affinity of the input sequence. Further provided herein are methods, wherein at least one sequence when translated encodes for an antibody or antibody fragment having at least 50× higher binding affinity than a binding affinity of the input sequence. Further provided herein are methods, wherein each sequence comprises at least one variant in each CDR of a heavy chain or light chain relative to a germline sequence of the input sequence. Further provided herein are methods, wherein the nucleic acid library has a theoretical diversity of at least $10^{10}$ sequences. Further provided herein are methods, wherein the nucleic acid library has a theoretical diversity of at least $10^{12}$ sequences.

BRIEF DESCRIPTION OF THE DRAWINGS

FIG. 14 is a graph of variant 4-23 binding in VERO E6 cells.

FIGS. 15A-15C are graphs of variant antibody binding in VERO E6 cells.

FIGS. 33A-33D are graphs of variant antibodies neutralizing live virus.

FIG. 35 shows an exemplary sequence of a SARS-CoV-2 membrane glycoprotein construct. FIG. 35 discloses SEQ ID NO: 2673.

FIGS. 38A-38J show graphs of FACS titration data for membrane glycoprotein variant antibodies.

FIG. 42A shows a graph of the positive control in a neutralization assay.

FIGS. 42B-42C show graphs of neutralization by antibodies described herein.

DETAILED DESCRIPTION

Figure 1:
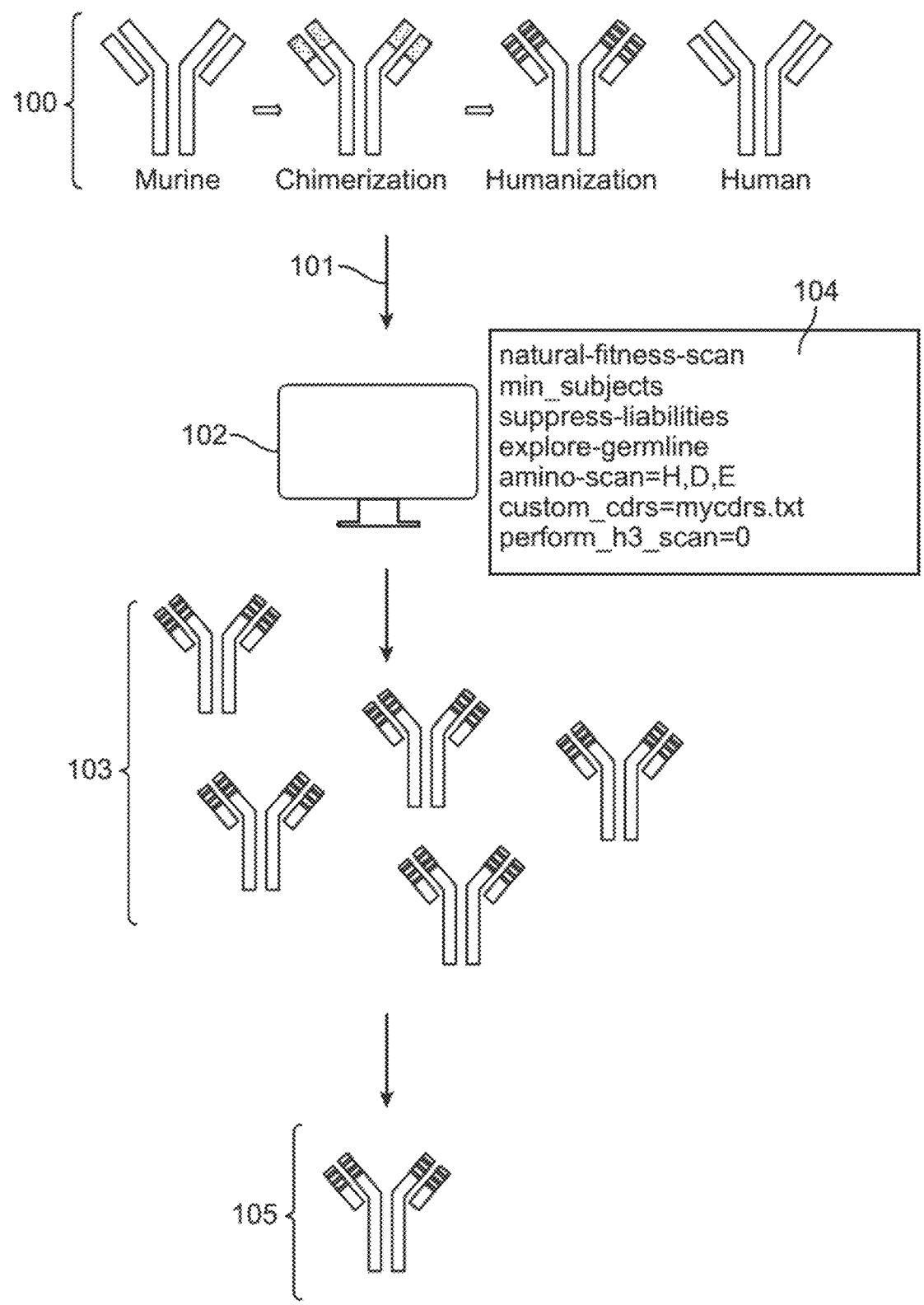
FIG. 1 depicts a workflow for antibody optimization.

The present disclosure employs, unless otherwise indicated, conventional molecular biology techniques, which are within the skill of the art. Unless defined otherwise, all technical and scientific terms used herein have the same meaning as is commonly understood by one of ordinary skill in the art.

Definitions

Throughout this disclosure, various embodiments are presented in a range format. It should be understood that the description in range format is merely for convenience and brevity and should not be construed as an inflexible limitation on the scope of any embodiments. Accordingly, the description of a range should be considered to have specifically disclosed all the possible subranges as well as individual numerical values within that range to the tenth of the unit of the lower limit unless the context clearly dictates otherwise. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual values within that range, for example, 1.1, 2, 2.3, 5, and 5.9. This applies regardless of the breadth of the range. The upper and lower limits of these intervening ranges may independently be included in the smaller ranges, and are also encompassed within the disclosure, subject to any specifically excluded limit in the stated range. Where the stated range includes one or both of the limits, ranges excluding either or both of those included limits are also included in the disclosure, unless the context clearly dictates otherwise.

The terminology used herein is for the purpose of describing particular embodiments only and is not intended to be limiting of any embodiment. As used herein, the singular forms "a," "an" and "the" are intended to include the plural forms as well, unless the context clearly indicates otherwise. It will be further understood that the terms "comprises" and/or "comprising," when used in this specification, specify the presence of stated features, integers, steps, operations, elements, and/or components, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers+/−10% thereof, or 10% below the lower listed limit and 10% above the higher listed limit for the values listed for a range.

Unless specifically stated, as used herein, the term "nucleic acid" encompasses double- or triple-stranded nucleic acids, as well as single-stranded molecules. In double- or triple-stranded nucleic acids, the nucleic acid strands need not be coextensive (i.e., a double-stranded nucleic acid need not be double-stranded along the entire length of both strands). Nucleic acid sequences, when provided, are listed in the 5' to 3' direction, unless stated otherwise. Methods described herein provide for the generation of isolated nucleic acids. Methods described herein additionally provide for the generation of isolated and purified nucleic acids. A "nucleic acid" as referred to herein can comprise at least 5, 10, 20, 30, 40, 50, 60, 70, 80, 90, 100, 125, 150, 175, 200, 225, 250, 275, 300, 325, 350, 375, 400, 425, 450, 475, 500, 600, 700, 800, 900, 1000, 1100, 1200, 1300, 1400, 1500, 1600, 1700, 1800, 1900, 2000, or more bases in length. Moreover, provided herein are methods for the synthesis of any number of polypeptide-segments encoding nucleotide sequences, including sequences encoding non-ribosomal peptides (NRPs), sequences encoding non-ribosomal peptide-synthetase (NRPS) modules and synthetic variants, polypeptide segments of other modular proteins, such as antibodies, polypeptide segments from other protein families, including non-coding DNA or RNA, such as regulatory sequences e.g. promoters, transcription factors, enhancers, siRNA, shRNA, RNAi, miRNA, small nucleolar RNA derived from microRNA, or any functional or structural DNA or RNA unit of interest. The following are non-limiting examples of polynucleotides: coding or non-coding regions of a gene or gene fragment, intergenic DNA, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), small nucleolar RNA, ribozymes, complementary DNA (cDNA), which is a DNA representation of mRNA, usually obtained by reverse transcription of messenger RNA (mRNA) or by amplification; DNA molecules produced synthetically or by amplification, genomic DNA, recombinant polynucleotides, branched polynucleotides, plasmids, vectors, isolated DNA of any sequence, isolated RNA of any sequence, nucleic acid probes, and primers. cDNA encoding for a gene or gene fragment referred herein may comprise at least one region encoding for exon sequences without an intervening intron sequence in the genomic equivalent sequence. cDNA described herein may be generated by de novo synthesis.

Antibody Optimization Library for Coronavirus

Provided herein are methods, compositions, and systems for the optimization of antibodies for coronavirus. In some embodiments, the antibodies are optimized for SARS-CoV, MERS-CoV, CoV-229E, HCoV-NL63, HCoV-OC43, or HCoV-HKU1. In some embodiments, the antibodies are optimized for SARS-CoV-2. In some embodiments, the antibodies are optimized for a receptor that binds to the coronavirus. In some embodiments, the receptor of the coronavirus is ACE2 or dipeptidyl peptidase 4 (DPP4). In some embodiments, the antibodies are optimized based on interactions between the coronavirus and the receptor that binds the coronavirus. In some embodiments, the antibodies are optimized for angiotensin-converting enzyme 2 (ACE2). In some embodiments, the antibodies are optimized based on interactions between SARS-CoV-2 and ACE2.

Antibodies are in some instances optimized by the design of in-silico libraries comprising variant sequences of an input antibody sequence (FIG. 1). Input sequences 100 are in some instances modified in-silico 102 with one or more mutations or variants to generate libraries of optimized sequences 103. In some instances, such libraries are synthesized, cloned into expression vectors, and translation products (antibodies) evaluated for activity. In some instances, fragments of sequences are synthesized and subsequently assembled. In some instances, expression vectors are used to display and enrich desired antibodies, such as phage display. Selection pressures used during enrichment in some instances includes, but is not limited to, binding affinity, toxicity, immunological tolerance, stability, receptor-ligand competition, or developability. Such expression vectors allow antibodies with specific properties to be selected ("panning"), and subsequent propagation or amplification of such sequences enriches the library with these sequences. Panning rounds can be repeated any number of times, such as 1, 2, 3, 4, 5, 6, 7, or more than 7 rounds. Sequencing at one or more rounds is in some instances used to identify which sequences 105 have been enriched in the library.

Described herein are methods and systems of in-silico library design. For example, an antibody or antibody fragment sequence is used as input. In some instances, the antibody sequence used as input is an antibody or antibody fragment sequence that binds SARS-CoV-2. In some instances, the input is an antibody or antibody fragment sequence that binds a protein of SARS-CoV-2. In some instances, the protein is a spike glycoprotein, a membrane protein, an envelope protein, a nucleocapsid protein, or combinations thereof. In some instances, the protein is a spike glycoprotein of SARS-CoV-2. In some instances, the protein is a receptor binding domain of SARS-CoV-2. In some instances, the input sequence is an antibody or antibody fragment sequence that binds angiotensin-converting enzyme 2 (ACE2). In some instances, the input sequence is an antibody or antibody fragment sequence that binds an extracellular domain of the angiotensin-converting enzyme 2 (ACE2).

A database 102 comprising known mutations or variants of one or more viruses is queried 101, and a library 103 of sequences comprising combinations of these mutations or variants are generated. In some instances, the database comprises known mutations or variants of SARS-CoV-like coronaviruses, SARS-CoV-2, SARS-CoV, or combinations thereof. In some instances, the database comprises known mutations or variants of the spike protein of SARS-CoV-like coronaviruses, SARS-CoV-2, SARS-CoV, or combinations thereof. In some instances, the database comprises known mutations or variants of the receptor binding domain of SARS-CoV-like coronaviruses, SARS-CoV-2, SARS-CoV, or combinations thereof. In some instances, the database comprises mutations or variants of a protein of SARS-CoV-like coronaviruses, SARS-CoV-2, SARS-CoV, or combinations thereof that binds to ACE2.

In some instances, the input sequence is a heavy chain sequence of an antibody or antibody fragment that binds SARS-CoV-like coronaviruses, SARS-CoV-2, SARS-CoV, or combinations thereof. In some instances, the input sequence is a light chain sequence of an antibody or antibody fragment that binds SARS-CoV-like coronaviruses, SARS-CoV-2, SARS-CoV, or combinations thereof. In some instances, the heavy chain sequence comprises varied CDR regions. In some instances, the light chain sequence comprises varied CDR regions. In some instances, known mutations or variants from CDRs are used to build the sequence library. Filters 104, or exclusion criteria, are in some instances used to select specific types of variants for members of the sequence library. For example, sequences having a mutation or variant are added if a minimum number of organisms in the database have the mutation or variant. In some instances, additional CDRs are specified for inclusion in the database. In some instances, specific mutations or variants or combinations of mutations or variants are excluded from the library (e.g., known immunogenic sites, structure sites, etc.). In some instances, specific sites in the input sequence are systematically replaced with histidine, aspartic acid, glutamic acid, or combinations thereof. In some instances, the maximum or minimum number of mutations or variants allowed for each region of an antibody are specified. Mutations or variants in some instances are described relative to the input sequence or the input sequence's corresponding germline sequence. For example, sequences generated by the optimization comprise at least 1, 2, 3, 4, 5, 6, 7, 8, 9, 10, 11, 12, 13, 14, 15, 16, or more than 16 mutations or variants from the input sequence. In some instances, sequences generated by the optimization comprise no more than 1, 2, 3, 4, 5, 6, 7, 8, 9, 10, 11, 12, 13, 14, 15, 16, or no more than 18 mutations or variants from the input sequence. In some instances, sequences generated by the optimization comprise about 1, 2, 3, 4, 5, 6, 7, 8, 9, 10, 11, 12, 13, 14, 15, 16, or about 18 mutations or variants relative to the input sequence. In some instances, sequences generated by the optimization comprise about 1, 2, 3, 4, 5, 6, or 7 mutations or variants from the input sequence in a first CDR region. In some instances, sequences generated by the optimization comprise about 1, 2, 3, 4, 5, 6, or 7 mutations or variants from the input sequence in a second CDR region. In some instances, sequences generated by the optimization comprise about 1, 2, 3, 4, 5, 6, or 7 mutations or variants from the input sequence in a third CDR region. In some instances, sequences generated by the optimization comprise about 1, 2, 3, 4, 5, 6, or 7 mutations or variants from the input sequence in a first CDR region of a heavy chain. In some instances, sequences generated by the optimization comprise about 1, 2, 3, 4, 5, 6, or 7 mutations or variants from the input sequence in a second CDR region of a heavy chain. In some instances, sequences generated by the optimization comprise about 1, 2, 3, 4, 5, 6, or 7 mutations or variants from the input sequence in a third CDR region of a heavy chain. In some instances, sequences generated by the optimization comprise about 1, 2, 3, 4, 5, 6, or 7 mutations or variants from the input sequence in a first CDR region of a light chain. In some instances, sequences generated by the optimization comprise about 1, 2, 3, 4, 5, 6, or 7 mutations or variants from the input sequence in a second CDR region of a light chain. In some instances, sequences generated by the optimization comprise about 1, 2, 3, 4, 5, 6, or 7 mutations or variants from the input sequence in a third CDR region of a light chain. In some instances, a first CDR region is CDR1. In some instances, a second CDR region is CDR2. In some instances, a third CDR region is CDR3. In-silico antibodies libraries are in some instances synthesized, assembled, and enriched for desired sequences.

The germline sequences corresponding to an input sequence may also be modified to generate sequences in a library. For example, sequences generated by the optimization methods described herein comprise at least 1, 2, 3, 4, 5, 6, 7, 8, 9, 10, 11, 12, 13, 14, 15, 16, or more than 16 mutations or variants from the germline sequence. In some instances, sequences generated by the optimization comprise no more than 1, 2, 3, 4, 5, 6, 7, 8, 9, 10, 11, 12, 13, 14, 15, 16, or no more than 18 mutations or variants from the germline sequence. In some instances, sequences generated by the optimization comprise about 1, 2, 3, 4, 5, 6, 7, 8, 9, 10, 11, 12, 13, 14, 15, 16, or about 18 mutations or variants relative to the germline sequence.

Provided herein are methods, systems, and compositions for antibody optimization, wherein the input sequence comprises mutations or variants in an antibody region. Exemplary regions of the antibody include, but are not limited to, a complementarity-determining region (CDR), a variable domain, or a constant domain. In some instances, the CDR is CDR1, CDR2, or CDR3. In some instances, the CDR is a heavy domain including, but not limited to, CDRH1, CDRH2, and CDRH3. In some instances, the CDR is a light domain including, but not limited to, CDRL1, CDRL2, and CDRL3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH). In some instances, sequences generated by the optimization comprise about 1, 2, 3, 4, 5, 6, or 7 mutations or variants from the germline sequence in a first CDR region. In some instances, sequences generated by the optimization comprise about 1, 2, 3, 4, 5, 6, or 7 mutations or variants from the germline sequence in a second CDR region. In some instances, sequences generated by the optimization comprise about 1, 2, 3, 4, 5, 6, or 7 mutations or variants from the germline sequence in a third CDR region. In some instances, sequences generated by the optimization comprise about 1, 2, 3, 4, 5, 6, or 7 mutations or variants from the germline sequence in a first CDR region of a heavy chain. In some instances, sequences generated by the optimization comprise about 1, 2, 3, 4, 5, 6, or 7 mutations or variants from the germline sequence in a second CDR region of a heavy chain. In some instances, sequences generated by the optimization comprise about 1, 2, 3, 4, 5, 6, or 7 mutations or variants from the germline sequence in a third CDR region of a heavy chain. In some instances, sequences generated by the optimization comprise about 1, 2, 3, 4, 5, 6, or 7 mutations or variants from the germline sequence in a first CDR region of a light chain. In some instances, sequences generated by the optimization comprise about 1, 2, 3, 4, 5, 6, or 7 mutations or variants from the germline sequence in a second CDR region of a light chain. In some instances, sequences generated by the optimization comprise about 1, 2, 3, 4, 5, 6, or 7 mutations or variants from the germline sequence in a third CDR region of a light chain. In some instances, a first CDR region is CDR1. In some instances, a second CDR region is CDR2. In some instances, a third CDR region is CDR3.

VHH Libraries

Provided herein are methods, compositions, and systems for generation of antibodies or antibody fragments. In some instances, the antibodies or antibody fragments are single domain antibodies. Methods, compositions, and systems described herein for the optimization of antibodies comprise a ratio-variant approach that mirror the natural diversity of antibody sequences. In some instances, libraries of optimized antibodies comprise variant antibody sequences. In some instances, the variant antibody sequences are designed comprising variant CDR regions. In some instances, the variant antibody sequences comprising variant CDR regions are generated by shuffling the natural CDR sequences in a llama, humanized, or chimeric framework. In some instances, such libraries are synthesized, cloned into expression vectors, and translation products (antibodies) evaluated for activity. In some instances, fragments of sequences are synthesized and subsequently assembled. In some instances, expression vectors are used to display and enrich desired antibodies, such as phage display. In some instances, the phage vector is a Fab phagemid vector. Selection pressures used during enrichment in some instances includes, but is not limited to, binding affinity, toxicity, immunological tolerance, stability, receptor-ligand competition, or developability. Such expression vectors allow antibodies with specific properties to be selected ("panning"), and subsequent propagation or amplification of such sequences enriches the library with these sequences. Panning rounds can be repeated any number of times, such as 1, 2, 3, 4, 5, 6, 7, or more than 7 rounds. In some instances, each round of panning involves a number of washes. In some instances, each round of panning involves at least or about 1, 2, 3, 4, 5, 6, 7, 8, 9, 10, 11, 12, 13, 14, 15, 16, or more than 16 washes.

Described herein are methods and systems of in-silico library design. Libraries as described herein, in some instances, are designed based on a database comprising a variety of antibody sequences. In some instances, the database comprises a plurality of variant antibody sequences against various targets. In some instances, the database comprises at least 100, 500, 1000, 1500, 2000, 2500, 3000, 3500, 4000, 4500, 5000, or more than 5000 antibody sequences. An exemplary database is an iCAN database. In some instances, the database comprises naïve and memory B-cell receptor sequences. In some instances, the naïve and memory B-cell receptor sequences are human, mouse, or primate sequences. In some instances, the naïve and memory B-cell receptor sequences are human sequences. In some instances, the database is analyzed for position specific variation. In some instances, antibodies described herein comprise position specific variations in CDR regions. In some instances, the CDR regions comprise multiple sites for variation.

Described herein are libraries comprising variation in a CDR region. In some instances, the CDR is CDR1, CDR2, or CDR3 of a variable heavy chain. In some instances, the CDR is CDR1, CDR2, or CDR3 of a variable light chain. In some instances, the libraries comprise multiple variants encoding for CDR1, CDR2, or CDR3. In some instances, the libraries as described herein encode for at least 50, 100, 200, 300, 400, 500, 1000, 1200, 1500, 1700, 2000, 2500, 3000, 3500, 4000, 4500, 5000, or more than 5000 CDR1 sequences. In some instances, the libraries as described herein encode for at least 50, 100, 200, 300, 400, 500, 1000, 1200, 1500, 1700, 2000, 2500, 3000, 3500, 4000, 4500, 5000, or more than 5000 CDR2 sequences. In some instances, the libraries as described herein encode for at least 50, 100, 200, 300, 400, 500, 1000, 1200, 1500, 1700, 2000, 2500, 3000, 3500, 4000, 4500, 5000, or more than 5000 CDR3 sequences. In-silico antibodies libraries are in some instances synthesized, assembled, and enriched for desired sequences.

Following synthesis of CDR1 variants, CDR2 variants, and CDR3 variants, in some instances, the CDR1 variants, the CDR2 variants, and the CDR3 variants are shuffled to generate a diverse library. In some instances, the diversity of the libraries generated by methods described herein have a theoretical diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, or more than $10^{18}$ sequences. In some instances, the library has a final library diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, or more than $10^{18}$ sequences.

The germline sequences corresponding to a variant sequence may also be modified to generate sequences in a library. For example, sequences generated by methods described herein comprise at least 1, 2, 3, 4, 5, 6, 7, 8, 9, 10, 11, 12, 13, 14, 15, 16, or more than 16 mutations or variants from the germline sequence. In some instances, sequences generated comprise no more than 1, 2, 3, 4, 5, 6, 7, 8, 9, 10, 11, 12, 13, 14, 15, 16, or no more than 18 mutations or variants from the germline sequence. In some instances, sequences generated comprise about 1, 2, 3, 4, 5, 6, 7, 8, 9, 10, 11, 12, 13, 14, 15, 16, or about 18 mutations or variants relative to the germline sequence.

Coronavirus Antibody Libraries

Provided herein are libraries generated from antibody optimization methods described herein. Antibodies described herein result in improved functional activity, structural stability, expression, specificity, or a combination thereof.

Provided herein are methods and compositions relating to SARS-CoV-2 binding libraries comprising nucleic acids encoding for a SARS-CoV-2 antibody. Further provided herein are methods and compositions relating to ACE2 binding libraries comprising nucleic acids encoding for an ACE2 antibody. Such methods and compositions in some instances are generated by the antibody optimization methods and systems described herein. Libraries as described herein may be further variegated to provide for variant libraries comprising nucleic acids each encoding for a predetermined variant of at least one predetermined reference nucleic acid sequence. Further described herein are protein libraries that may be generated when the nucleic acid libraries are translated. In some instances, nucleic acid libraries as described herein are transferred into cells to generate a cell library. Also provided herein are downstream applications for the libraries synthesized using methods described herein. Downstream applications include identification of variant nucleic acids or protein sequences with enhanced biologically relevant functions, e.g., improved stability, affinity, binding, functional activity, and for the treatment or prevention of an infection caused by a coronavirus such as SARS-CoV-2.

In some instances, an antibody or antibody fragment described herein comprises a sequence of any one of SEQ ID NOs: 1-2668. In some instances, an antibody or antibody fragment described herein comprises a sequence that is at least 80% identical to a sequence of any one of SEQ ID NOs: 1-2668. In some instances, an antibody or antibody fragment described herein comprises a sequence that is at least 85% identical to a sequence of any one of SEQ ID NOs: 1-2668. In some instances, an antibody or antibody fragment described herein comprises a sequence that is at least 90% identical to a sequence of any one of SEQ ID NOs: 1-2668. In some instances, an antibody or antibody fragment described herein comprises a sequence that is at least 95% identical to a sequence of any one of SEQ ID NOs: 1-2668.

In some instances, an antibody or antibody fragment described herein comprises a CDRH1 sequence of any one of SEQ ID NOs: 151-165, 241-255, 331-357, and 547-575. In some instances, an antibody or antibody fragment described herein comprises a sequence that is at least 80% identical to a CDRH1 sequence of any one of SEQ ID NOs: 151-165, 241-255, 331-357, and 547-575. In some instances, an antibody or antibody fragment described herein comprises a sequence that is at least 85% identical to a CDRH1 sequence of any one of SEQ ID NOs: 151-165, 241-255, 331-357, and 547-575. In some instances, an antibody or antibody fragment described herein comprises a sequence that is at least 90% identical to a CDRH1 sequence of any one of SEQ ID NOs: 151-165, 241-255, 331-357, and 547-575. In some instances, an antibody or antibody fragment described herein comprises a sequence that is at least 95% identical to a CDRH1 sequence of any one of SEQ ID NOs: 151-165, 241-255, 331-357, and 547-575. In some instances, an antibody or antibody fragment described herein comprises a CDRH2 sequence of any one of SEQ ID NOs: 166-180, 256-270, 358-384, and 576-604. In some instances, an antibody or antibody fragment described herein comprises a sequence that is at least 80% identical to a CDRH2 sequence of any one of SEQ ID NOs: 166-180, 256-270, 358-384, and 576-604. In some instances, an antibody or antibody fragment described herein comprises a sequence that is at least 85% identical to a CDRH2 sequence of any one of SEQ ID NOs: 166-180, 256-270, 358-384, and 576-604. In some instances, an antibody or antibody fragment described herein comprises a sequence that is at least 90% identical to a CDRH2 sequence of any one of SEQ ID NOs: 166-180, 256-270, 358-384, and 576-604. In some instances, an antibody or antibody fragment described herein comprises a sequence that is at least 95% identical to a CDRH2 sequence of any one of SEQ ID NOs: 166-180, 256-270, 358-384, and 576-604. In some instances, an antibody or antibody fragment described herein comprises a CDRH3 sequence of any one of SEQ ID NOs: 181-195, 271-285, 385-411, and 605-633. In some instances, an antibody or antibody fragment described herein comprises a sequence that is at least 80% identical to a CDRH3 sequence of any one of SEQ ID NOs: 181-195, 271-285, 385-411, and 605-633. In some instances, an antibody or antibody fragment described herein comprises a sequence that is at least 85% identical to a CDRH3 sequence of any one of SEQ ID NOs: 181-195, 271-285, 385-411, and 605-633. In some instances, an antibody or antibody fragment described herein comprises a sequence that is at least 90% identical to a CDRH3 sequence of any one of SEQ ID NOs: 181-195, 271-285, 385-411, and 605-633. In some instances, an antibody or antibody fragment described herein comprises a sequence that is at least 95% identical to a CDRH3 sequence of any one of SEQ ID NOs: 181-195, 271-285, 385-411, and 605-633.

In some instances, an antibody or antibody fragment described herein comprises a CDRH1 sequence of any one of SEQ ID NOs: 1-50, 779-919, 1344-1523, and 2381-2452. In some instances, an antibody or antibody fragment described herein comprises a sequence that is at least 80% identical to a CDRH1 sequence of any one of SEQ ID NOs: 1-50, 779-919, 1344-1523, and 2381-2452. In some instances, an antibody or antibody fragment described herein comprises a sequence that is at least 85% identical to a CDRH1 sequence of any one of SEQ ID NOs: 1-50, 779-919, 1344-1523, and 2381-2452. In some instances, an antibody or antibody fragment described herein comprises a sequence that is at least 90% identical to a CDRH1 sequence of any one of SEQ ID NOs: 1-50, 779-919, 1344-1523, and 2381-2452. In some instances, an antibody or antibody fragment described herein comprises a sequence that is at least 95% identical to a CDRH1 sequence of any one of SEQ ID NOs: 1-50, 779-919, 1344-1523, and 2381-2452. In some instances, an antibody or antibody fragment described herein comprises a CDRH2 sequence of any one of SEQ ID NOs: 51-100, 920-1061, 1524-1703, and 2453-2524. In some instances, an antibody or antibody fragment described herein comprises a sequence that is at least 80% identical to a CDRH2 sequence of any one of SEQ ID NOs: 51-100, 920-1061, 1524-1703, and 2453-2524. In some instances, an antibody or antibody fragment described herein comprises a sequence that is at least 85% identical to a CDRH2 sequence of any one of SEQ ID NOs: 51-100, 920-1061, 1524-1703, and 2453-2524. In some instances, an antibody or antibody fragment described herein comprises a sequence that is at least 90% identical to a CDRH2 sequence of any one of SEQ ID NOs: 51-100, 920-1061, 1524-1703, and 2453-2524. In some instances, an antibody or antibody fragment described herein comprises a sequence that is at least 95% identical to a CDRH2 sequence of any one of SEQ ID NOs: 51-100, 920-1061, 1524-1703, and 2453-2524. In some instances, an antibody or antibody fragment described herein comprises a CDRH3 sequence of any one of SEQ ID NOs: 101-150, 1062-1202, 1704-1883, and 2525-2596. In some instances, an antibody or antibody fragment described herein comprises a sequence that is at least 80% identical to a CDRH3 sequence of any one of SEQ ID NOs: 101-150, 1062-1202, 1704-1883, and 2525-2596. In some instances, an antibody or antibody fragment described herein comprises a sequence that is at least 85% identical to a CDRH3 sequence of any one of SEQ ID NOs: 101-150, 1062-1202, 1704-1883, and 2525-2596. In some instances, an antibody or antibody fragment described herein comprises a sequence that is at least 90% identical to a CDRH3 sequence of any one of SEQ ID NOs: 101-150, 1062-1202, 1704-1883, and 2525-2596. In some instances, an antibody or antibody fragment described herein comprises a sequence that is at least 95% identical to a CDRH3 sequence of any one of SEQ ID NOs: 101-150, 1062-1202, 1704-1883, and 2525-2596.

In some instances, an antibody or antibody fragment described herein comprises a CDRL1 sequence of any one of SEQ ID NOs: 196-210, 286-300, 412-438, and 634-662. In some instances, an antibody or antibody fragment described herein comprises a sequence that is at least 80% identical to a CDRL1 sequence of any one of SEQ ID NOs: 196-210, 286-300, 412-438, and 634-662. In some instances, an antibody or antibody fragment described herein comprises a sequence that is at least 85% identical to a CDRL1 sequence of any one of SEQ ID NOs: 196-210, 286-300, 412-438, and 634-662. In some instances, an antibody or antibody fragment described herein comprises a sequence that is at least 90% identical to a CDRL1 sequence of any one of SEQ ID NOs: 1196-210, 286-300, 412-438, and 634-662. In some instances, an antibody or antibody fragment described herein comprises a sequence that is at least 95% identical to a CDRL1 sequence of any one of SEQ ID NOs: 196-210, 286-300, 412-438, and 634-662. In some instances, an antibody or antibody fragment described herein comprises a CDRL2 sequence of any one of SEQ ID NOs: 211-225, 301-315, 439-465, and 663-691. In some instances, an antibody or antibody fragment described herein comprises a sequence that is at least 80% identical to a CDRL2 sequence of any one of SEQ ID NOs: 211-225, 301-315, 439-465, and 663-691. In some instances, an antibody or antibody fragment described herein comprises a sequence that is at least 85% identical to a CDRL2 sequence of any one of SEQ ID NOs: 211-225, 301-315, 439-465, and 663-691. In some instances, an antibody or antibody fragment described herein comprises a sequence that is at least 90% identical to a CDRL2 sequence of any one of SEQ ID NOs: 211-225, 301-315, 439-465, and 663-691. In some instances, an antibody or antibody fragment described herein comprises a sequence that is at least 95% identical to a CDRL2 sequence of any one of SEQ ID NOs: 211-225, 301-315, 439-465, and 663-691. In some instances, an antibody or antibody fragment described herein comprises a CDRL3 sequence of any one of SEQ ID NOs: 226-240, 316-330, 466-492, and 692-720. In some instances, an antibody or antibody fragment described herein comprises a sequence that is at least 80% identical to a CDRL3 sequence of any one of SEQ ID NOs: 226-240, 316-330, 466-492, and 692-720. In some instances, an antibody or antibody fragment described herein comprises a sequence that is at least 85% identical to a CDRL3 sequence of any one of SEQ ID NOs: 226-240, 316-330, 466-492, and 692-720. In some instances, an antibody or antibody fragment described herein comprises a sequence that is at least 90% identical to a CDRL3 sequence of any one of SEQ ID NOs: 226-240, 316-330, 466-492, and 692-720. In some instances, an antibody or antibody fragment described herein comprises a sequence that is at least 95% identical to a CDRL3 sequence of any one of SEQ ID NOs: 226-240, 316-330, 466-492, and 692-720.

In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 151-165, 241-255, 331-357, and 547-575; (b) an amino acid sequence of CDRH2 is as set forth in any one of SEQ ID NOs: 166-180, 256-270, 358-384, and 576-604; (c) an amino acid sequence of CDRH3 is as set forth in any one of SEQ ID NOs: 181-195, 271-285, 385-411, and 605-633; (d) an amino acid sequence of CDRL1 is as set forth in any one of SEQ ID NOs: 196-210, 286-300, 412-438, and 634-662; (e) an amino acid sequence of CDRL2 is as set forth in any one of SEQ ID NOs: 211-225, 301-315, 439-465, and 663-691; and (f) an amino acid sequence of CDRL3 is as set forth in any one of SEQ ID NOs: 226-240, 316-330, 466-492, and 692-720. In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is at least or about 80%, 85%, 90%, or 95% identical to any one of SEQ ID NOs: 151-165, 241-255, 331-357, and 547-575; (b) an amino acid sequence of CDRH2 is at least or about 80%, 85%, 90%, or 95% identical to any one of SEQ ID NOs: 166-180, 256-270, 358-384, and 576-604; (c) an amino acid sequence of CDRH3 is at least or about 80%, 85%, 90%, or 95% identical to any one of SEQ ID NOs: 181-195, 271-285, 385-411, and 605-633; (d) an amino acid sequence of CDRL1 is at least or about 80%, 85%, 90%, or 95% identical to any one of SEQ ID NOs: 196-210, 286-300, 412-438, and 634-662; (e) an amino acid sequence of CDRL2 is at least or about 80%, 85%, 90%, or 95% identical to any one of SEQ ID NOs: 211-225, 301-315, 439-465, and 663-691; and (f) an amino acid sequence of CDRL3 is at least or about 80%, 85%, 90%, or 95% identical to any one of SEQ ID NOs: 226-240, 316-330, 466-492, and 692-720.

Described herein, in some embodiments, are antibodies or antibody fragments comprising a variable domain, heavy chain region (VH) and a variable domain, light chain region (VL), wherein the VH comprises an amino acid sequence at least about 90% identical to a sequence as set forth in any one of SEQ ID NOs: 493-519 and 721-749, and wherein the VL comprises an amino acid sequence at least about 90% identical to a sequence as set forth in any one of SEQ ID NOs: 520-546 and 750-778. In some instances, the antibodies or antibody fragments comprise VH comprising at least or about 70%, 80%, 85%, 90%, 91%, 92%, 93%, 94%, 95%, 96%, 97%, 98%, 99%, or 100% sequence identity to any one of SEQ ID NOs: 493-519 and 721-749, and VL comprising at least or about 70%, 80%, 85%, 90%, 91%, 92%, 93%, 94%, 95%, 96%, 97%, 98%, 99%, or 100% sequence identity to any one of SEQ ID NOs: 520-546 and 750-778.

Described herein, in some embodiments, are antibodies or antibody fragments comprising a variable domain, heavy chain region (VH), wherein the VH comprises an amino acid sequence at least about 90% identical to a sequence as set forth in any one of SEQ ID NOs: 1884-2063, 2302-2380, and 2597-2668. In some instances, the antibodies or antibody fragments comprise a heavy chain variable domain comprising at least or about 70%, 80%, 85%, 90%, 91%, 92%, 93%, 94%, 95%, 96%, 97%, 98%, 99%, or 100% sequence identity to any one of SEQ ID NOs: 1884-2063, 2302-2380, and 2597-2668.

The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity.

The term "homology" or "similarity" between two proteins is determined by comparing the amino acid sequence and its conserved amino acid substitutes of one protein sequence to the second protein sequence. Similarity may be determined by procedures which are well-known in the art, for example, a BLAST program (Basic Local Alignment Search Tool at the National Center for Biological Information).

Provided herein are libraries comprising nucleic acids encoding for SARS-CoV-2 antibodies. Antibodies described herein allow for improved stability for a range of SARS-CoV-2 or ACE2 binding domain encoding sequences. In some instances, the binding domain encoding sequences are determined by interactions between SARS-CoV-2 and ACE2.

Sequences of binding domains based on surface interactions between SARS-CoV-2 and ACE2 are analyzed using various methods. For example, multispecies computational analysis is performed. In some instances, a structure analysis is performed. In some instances, a sequence analysis is performed. Sequence analysis can be performed using a database known in the art. Non-limiting examples of databases include, but are not limited to, NCBI BLAST (blast.ncbi.nlm.nih.gov/Blast.cgi), UCSC Genome Browser (genome.ucsc.edu/), UniProt (www.uniprot.org/), and IUPHAR/BPS Guide to PHARMACOLOGY (guidetopharmacology.org/).

Described herein are SARS-CoV-2 or ACE2 binding domains designed based on sequence analysis among various organisms. For example, sequence analysis is performed to identify homologous sequences in different organisms. Exemplary organisms include, but are not limited to, mouse, rat, equine, sheep, cow, primate (e.g., chimpanzee, baboon, gorilla, orangutan, monkey), dog, cat, pig, donkey, rabbit, fish, fly, and human. In some instances, homologous sequences are identified in the same organism, across individuals.

Following identification of SARS-CoV-2 or ACE2 binding domains, libraries comprising nucleic acids encoding for the SARS-CoV-2 or ACE2 binding domains may be generated. In some instances, libraries of SARS-CoV-2 or ACE2 binding domains comprise sequences of SARS-CoV-2 or ACE2 binding domains designed based on conformational ligand interactions, peptide ligand interactions, small molecule ligand interactions, extracellular domains of SARS-CoV-2 or ACE2, or antibodies that target SARS-CoV-2 or ACE2. Libraries of SARS-CoV-2 or ACE2 binding domains may be translated to generate protein libraries. In some instances, libraries of SARS-CoV-2 or ACE2 binding domains are translated to generate peptide libraries, immunoglobulin libraries, derivatives thereof, or combinations thereof. In some instances, libraries of SARS-CoV-2 or ACE2 binding domains are translated to generate protein libraries that are further modified to generate peptidomimetic libraries. In some instances, libraries of SARS-CoV-2 or ACE2 binding domains are translated to generate protein libraries that are used to generate small molecules.

Methods described herein provide for synthesis of libraries of SARS-CoV-2 or ACE2 binding domains comprising nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the libraries of SARS-CoV-2 or ACE2 binding domains comprise varied nucleic acids collectively encoding variations at multiple positions. In some instances, the variant library comprises sequences encoding for variation of at least a single codon in a SARS-CoV-2 or ACE2 binding domain. In some instances, the variant library comprises sequences encoding for variation of multiple codons in a SARS-CoV-2 or ACE2 binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of libraries comprising nucleic acids encoding for the SARS-CoV-2 or ACE2 binding domains, wherein the libraries comprise sequences encoding for variation of length of the SARS-CoV-2 or ACE2 binding domains. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Following identification of SARS-CoV-2 or ACE2 binding domains, antibodies may be designed and synthesized to comprise the SARS-CoV-2 or ACE2 binding domains. Antibodies comprising SARS-CoV-2 or ACE2 binding domains may be designed based on binding, specificity, stability, expression, folding, or downstream activity. In some instances, the antibodies comprising SARS-CoV-2 or ACE2 binding domains enable contact with the SARS-CoV-2 or ACE2. In some instances, the antibodies comprising SARS-CoV-2 or ACE2 binding domains enables high affinity binding with the SARS-CoV-2 or ACE2. Exemplary amino acid sequences of SARS-CoV-2 or ACE2 binding domains comprise any one of SEQ ID NOs: 1-2668.

In some instances, the SARS-CoV-2 antibody comprises a binding affinity (e.g., $K_D$) to SARS-CoV-2 of less than 1 nM, less than 1.2 nM, less than 2 nM, less than 5 nM, less than 10 nM, less than 11 nm, less than 13.5 nM, less than 15 nM, less than 20 nM, less than 25 nM, or less than 30 nM. In some instances, the SARS-CoV-2 antibody comprises a $K_D$ of less than 1 nM. In some instances, the SARS-CoV-2 antibody comprises a $K_D$ of less than 1.2 nM. In some instances, the SARS-CoV-2 antibody comprises a $K_D$ of less than 2 nM. In some instances, the SARS-CoV-2 antibody comprises a $K_D$ of less than 5 nM. In some instances, the SARS-CoV-2 antibody comprises a $K_D$ of less than 10 nM. In some instances, the SARS-CoV-2 antibody comprises a $K_D$ of less than 13.5 nM. In some instances, the SARS-CoV-2 antibody comprises a $K_D$ of less than 15 nM. In some instances, the SARS-CoV-2 antibody comprises a $K_D$ of less than 20 nM. In some instances, the SARS-CoV-2 antibody comprises a $K_D$ of less than 25 nM. In some instances, the SARS-CoV-2 antibody comprises a $K_D$ of less than 30 nM.

In some instances, the ACE2 antibody comprises a binding affinity (e.g., $K_D$) to ACE2 of less than 1 nM, less than 1.2 nM, less than 2 nM, less than 5 nM, less than 10 nM, less than 11 nm, less than 13.5 nM, less than 15 nM, less than 20 nM, less than 25 nM, or less than 30 nM. In some instances, the ACE2 antibody comprises a $K_D$ of less than 1 nM. In some instances, the ACE2 antibody comprises a $K_D$ of less than 1.2 nM. In some instances, the ACE2 antibody comprises a $K_D$ of less than 2 nM. In some instances, the ACE2 antibody comprises a $K_D$ of less than 5 nM. In some instances, the ACE2 antibody comprises a $K_D$ of less than 10 nM. In some instances, the ACE2 antibody comprises a $K_D$ of less than 13.5 nM. In some instances, the ACE2 antibody comprises a $K_D$ of less than 15 nM. In some instances, the ACE2 antibody comprises a $K_D$ of less than 20 nM. In some instances, the ACE2 antibody comprises a $K_D$ of less than 25 nM. In some instances, the ACE2 antibody comprises a $K_D$ of less than 30 nM.

In some instances, the SARS-CoV-2 or ACE2 immunoglobulin is an agonist. In some instances, the SARS-CoV-2 or ACE2 immunoglobulin is an antagonist. In some instances, the SARS-CoV-2 or ACE2 immunoglobulin is an allosteric modulator. In some instances, the allosteric modulator is a negative allosteric modulator. In some instances, the allosteric modulator is a positive allosteric modulator. In some instances, the SARS-CoV-2 or ACE2 immunoglobulin results in agonistic, antagonistic, or allosteric effects at a concentration of at least or about 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, 120 nM, 140 nM, 160 nM, 180 nM, 200 nM, 300 nM, 400 nM, 500 nM, 600 nM, 700 nM, 800 nM, 900 nM, 1000 nM, or more than 1000 nM. In some instances, the SARS-CoV-2 or ACE2 immunoglobulin is a negative allosteric modulator. In some instances, the SARS-CoV-2 or ACE2 immunoglobulin is a negative allosteric modulator at a concentration of at least or about 0.001, 0.005, 0.01, 0.05, 0.1, 0.5, 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, or more than 100 nM. In some instances, the SARS-CoV-2 or ACE2 immunoglobulin is a negative allosteric modulator at a concentration in a range of about 0.001 to about 100, 0.01 to about 90, about 0.1 to about 80, 1 to about 50, about 10 to about 40 nM, or about 1 to about 10 nM. In some instances, the SARS-CoV-2 or ACE2 immunoglobulin comprises an EC50 or IC50 of at least or about 0.001, 0.0025, 0.005, 0.01, 0.025, 0.05, 0.06, 0.07, 0.08, 0.9, 0.1, 0.5, 1, 2, 3, 4, 5, 6, or more than 6 nM. In some instances, the SARS-CoV-2 or ACE2 immunoglobulin comprises an EC50 or IC50 of at least or about 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, or more than 100 nM.

In some instances, the affinity of the SARS-CoV-2 or ACE2 antibody generated by methods as described herein is at least or about 1.5×, 2.0×, 5×, 10×, 20×, 30×, 40×, 50×, 60×, 70×, 80×, 90×, 100×, 200×, or more than 200× improved binding affinity as compared to a comparator antibody. In some instances, the SARS-CoV-2 or ACE2 antibody generated by methods as described herein is at least or about 1.5×, 2.0×, 5×, 10×, 20×, 30×, 40×, 50×, 60×, 70×, 80×, 90×, 100×, 200×, or more than 200× improved function as compared to a comparator antibody. In some instances, the comparator antibody is an antibody with similar structure, sequence, or antigen target.

Provided herein are SARS-CoV-2 or ACE2 binding libraries comprising nucleic acids encoding for antibodies comprising SARS-CoV-2 or ACE2 binding domains comprise variation in domain type, domain length, or residue variation. In some instances, the domain is a region in the antibody comprising the SARS-CoV-2 or ACE2 binding domains. For example, the region is the VH, CDRH3, or VL domain. In some instances, the domain is the SARS-CoV-2 or ACE2 binding domain.

Methods described herein provide for synthesis of a SARS-CoV-2 or ACE21 binding library of nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the SARS-CoV-2 or ACE2 binding library comprises varied nucleic acids collectively encoding variations at multiple positions. In some instances, the variant library comprises sequences encoding for variation of at least a single codon of a VH or VL domain. In some instances, the variant library comprises sequences encoding for variation of at least a single codon in a SARS-CoV-2 or ACE2 binding domain. For example, at least one single codon of a SARS-CoV-2 or ACE2 binding domain is varied. In some instances, the variant library comprises sequences encoding for variation of multiple codons of a VH or VL domain. In some instances, the variant library comprises sequences encoding for variation of multiple codons in a SARS-CoV-2 or ACE2 binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of a SARS-CoV-2 or ACE2 binding library of nucleic acids each encoding for a predetermined variant of at least one predetermined reference nucleic acid sequence, wherein the SARS-CoV-2 or ACE2 binding library comprises sequences encoding for variation of length of a domain. In some instances, the domain is VH or VL domain. In some instances, the domain is the SARS-CoV-2 or ACE2 binding domain. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Provided herein are SARS-CoV-2 or ACE2 binding libraries comprising nucleic acids encoding for antibodies comprising SARS-CoV-2 or ACE2 binding domains, wherein the SARS-CoV-2 or ACE2 binding libraries are synthesized with various numbers of fragments. In some instances, the fragments comprise the VH or VL domain. In some instances, the SARS-CoV-2 or ACE2 binding libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

SARS-CoV-2 or ACE2 binding libraries comprising nucleic acids encoding for antibodies comprising SARS-CoV-2 or ACE2 binding domains as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 to about 75 amino acids.

SARS-CoV-2 or ACE2 binding libraries comprising de novo synthesized variant sequences encoding for antibodies comprising SARS-CoV-2 or ACE2 binding domains comprise a number of variant sequences. In some instances, a number of variant sequences is de novo synthesized for a CDRH1, CDRH2, CDRH3, CDRL1, CDRL2, CDRL3, VL, VH, or a combination thereof. In some instances, a number of variant sequences is de novo synthesized for framework element 1 (FW1), framework element 2 (FW2), framework element 3 (FW3), or framework element 4 (FW4). In some instances, a number of variant sequences are de novo synthesized for a SARS-CoV-2 or ACE2 binding domain. The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is about 10 to 300, 25 to 275, 50 to 250, 75 to 225, 100 to 200, or 125 to 150 sequences.

SARS-CoV-2 or ACE2 binding libraries comprising de novo synthesized variant sequences encoding for antibodies comprising SARS-CoV-2 or ACE2 binding domains comprise improved diversity. In some instances, variants include affinity maturation variants. Alternatively or in combination, variants include variants in other regions of the antibody including, but not limited to, CDRH1, CDRH2, CDRL1, CDRL2, and CDRL3. In some instances, the number of variants of the SARS-CoV-2 or ACE2 binding libraries is least or about $10^4$, $10^5$, $10^6$, $10^7$, $10^8$, $10^9$, $10^{10}$, $10^{11}$, $10^{12}$, $10^{13}$, $10^{14}$ or more than $10^{14}$ non-identical sequences.

Following synthesis of SARS-CoV-2 or ACE2 binding libraries comprising nucleic acids encoding antibodies comprising SARS-CoV-2 or ACE2 binding domains, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. For example, SARS-CoV-2 or ACE2 binding libraries comprise nucleic acids encoding antibodies comprising SARS-CoV-2 or ACE2 binding domains with multiple tags such as GFP, FLAG, and Lucy as well as a DNA barcode. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

As used herein, the term antibody will be understood to include proteins having the characteristic two-armed, Y-shape of a typical antibody molecule as well as one or more fragments of an antibody that retain the ability to specifically bind to an antigen. Exemplary antibodies include, but are not limited to, a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv) (including fragments in which the VL and VH are joined using recombinant methods by a synthetic or natural linker that enables them to be made as a single protein chain in which the VL and VH regions pair to form monovalent molecules, including single chain Fab and scFab), a single chain antibody, a Fab fragment (including monovalent fragments comprising the VL, VH, CL, and CH1 domains), a F(ab')2 fragment (including bivalent fragments comprising two Fab fragments linked by a disulfide bridge at the hinge region), a Fd fragment (including fragments comprising the VH and CH1 fragment), a Fv fragment (including fragments comprising the VL and VH domains of a single arm of an antibody), a single-domain antibody (dAb or sdAb) (including fragments comprising a VH domain), an isolated complementarity determining region (CDR), a diabody (including fragments comprising bivalent dimers such as two VL and VH domains bound to each other and recognizing two different antigens), a fragment comprised of only a single monomeric variable domain, disulfide-linked Fvs (sdFv), an intrabody, an anti-idiotypic (anti-Id) antibody, or ab antigen-binding fragments thereof. In some instances, the libraries disclosed herein comprise nucleic acids encoding for an antibody, wherein the antibody is a Fv antibody, including Fv antibodies comprised of the minimum antibody fragment which contains a complete antigen-recognition and antigen-binding site. In some embodiments, the Fv antibody consists of a dimer of one heavy chain and one light chain variable domain in tight, non-covalent association, and the three hypervariable regions of each variable domain interact to define an antigen-binding site on the surface of the VH-VL dimer. In some embodiments, the six hypervariable regions confer antigen-binding specificity to the antibody. In some embodiments, a single variable domain (or half of an Fv comprising only three hypervariable regions specific for an antigen, including single domain antibodies isolated from camelid animals comprising one heavy chain variable domain such as VHH antibodies or nanobodies) has the ability to recognize and bind antigen. In some instances, the libraries disclosed herein comprise nucleic acids encoding for an antibody, wherein the antibody is a single-chain Fv or scFv, including antibody fragments comprising a VH, a VL, or both a VH and VL domain, wherein both domains are present in a single polypeptide chain. In some embodiments, the Fv polypeptide further comprises a polypeptide linker between the VH and VL domains allowing the scFv to form the desired structure for antigen binding. In some instances, a scFv is linked to the Fc fragment or a VHH is linked to the Fc fragment (including minibodies). In some instances, the antibody comprises immunoglobulin molecules and immunologically active fragments of immunoglobulin molecules, e.g., molecules that contain an antigen binding site. Immunoglobulin molecules are of any type (e.g., IgG, IgE, IgM, IgD, IgA and IgY), class (e.g., IgG 1, IgG 2, IgG 3, IgG 4, IgA 1 and IgA 2) or subclass.

In some embodiments, the antibody is a multivalent antibody. In some embodiments, the antibody is a monovalent, bivalent, or multivalent antibody. In some instances, the antibody is monospecific, bispecific, or multispecific. In some embodiments, the antibody is monovalent monospecific, monovalent bispecific, monovalent multispecific, bivalent monospecific, bivalent bispecific, bivalent multispecific, multivalent monospecific, multivalent bispecific, multivalent multispecific. In some instances, the antibody is homodimeric, heterodimeric, or heterotrimeric.

In some embodiments, libraries comprise immunoglobulins that are adapted to the species of an intended therapeutic target. Generally, these methods include "mammalization" and comprises methods for transferring donor antigen-binding information to a less immunogenic mammal antibody acceptor to generate useful therapeutic treatments. In some instances, the mammal is mouse, rat, equine, sheep, cow, primate (e.g., chimpanzee, baboon, gorilla, orangutan, monkey), dog, cat, pig, donkey, rabbit, and human. In some instances, provided herein are libraries and methods for felinization and caninization of antibodies.

"Humanized" forms of non-human antibodies can be chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody Humanized antibodies may also comprise residues that are not found in either the recipient antibody or the donor antibody. In some instances, these modifications are made to further refine antibody performance.

"Caninization" can comprise a method for transferring non-canine antigen-binding information from a donor antibody to a less immunogenic canine antibody acceptor to generate treatments useful as therapeutics in dogs. In some instances, caninized forms of non-canine antibodies provided herein are chimeric antibodies that contain minimal sequence derived from non-canine antibodies. In some instances, caninized antibodies are canine antibody sequences ("acceptor" or "recipient" antibody) in which hypervariable region residues of the recipient are replaced by hypervariable region residues from a non-canine species ("donor" antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the canine antibody are replaced by corresponding non-canine FR residues. In some instances, caninized antibodies include residues that are not found in the recipient antibody or in the donor antibody. In some instances, these modifications are made to further refine antibody performance. The caninized antibody may also comprise at least a portion of an immunoglobulin constant region (Fc) of a canine antibody.

"Felinization" can comprise a method for transferring non-feline antigen-binding information from a donor antibody to a less immunogenic feline antibody acceptor to generate treatments useful as therapeutics in cats. In some instances, felinized forms of non-feline antibodies provided herein are chimeric antibodies that contain minimal sequence derived from non-feline antibodies. In some instances, felinized antibodies are feline antibody sequences ("acceptor" or "recipient" antibody) in which hypervariable region residues of the recipient are replaced by hypervariable region residues from a non-feline species ("donor" antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the feline antibody are replaced by corresponding non-feline FR residues. In some instances, felinized antibodies include residues that are not found in the recipient antibody or in the donor antibody. In some instances, these modifications are made to further refine antibody performance. The felinized antibody may also comprise at least a portion of an immunoglobulin constant region (Fc) of a felinize antibody.

Methods as described herein may be used for optimization of libraries encoding a non-immunoglobulin. In some instances, the libraries comprise antibody mimetics. Exemplary antibody mimetics include, but are not limited to, anticalins, affilins, affibody molecules, affimers, affitins, alphabodies, avimers, atrimers, DARPins, fynomers, Kunitz domain-based proteins, monobodies, anticalins, knottins, armadillo repeat protein-based proteins, and bicyclic peptides.

Libraries described herein comprising nucleic acids encoding for an antibody comprise variations in at least one region of the antibody. Exemplary regions of the antibody for variation include, but are not limited to, a complementarity-determining region (CDR), a variable domain, or a constant domain. In some instances, the CDR is CDR1, CDR2, or CDR3. In some instances, the CDR is a heavy domain including, but not limited to, CDRH1, CDRH2, and CDRH3. In some instances, the CDR is a light domain including, but not limited to, CDRL1, CDRL2, and CDRL3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH).

Methods described herein provide for synthesis of libraries comprising nucleic acids encoding an antibody, wherein each nucleic acid encodes for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the antibody library comprises varied nucleic acids collectively encoding variations at multiple positions. In some instances, the variant library comprises sequences encoding for variation of at least a single codon of a CDRH1, CDRH2, CDRH3, CDRL1, CDRL2, CDRL3, VL, or VH domain. In some instances, the variant library comprises sequences encoding for variation of multiple codons of a CDRH1, CDRH2, CDRH3, CDRL1, CDRL2, CDRL3, VL, or VH domain. In some instances, the variant library comprises sequences encoding for variation of multiple codons of framework element 1 (FW1), framework element 2 (FW2), framework element 3 (FW3), or framework element 4 (FW4). An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

In some instances, the at least one region of the antibody for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary regions of the antibody for variation include, but are not limited to, IGHV1-18, IGHV1-69, IGHV1-8, IGHV3-21, IGHV3-23, IGHV3-30/33rn, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, IGLV2-14, IGLV1-40, and IGLV3-1. In some instances, the gene is IGHV1-69, IGHV3-30, IGHV3-23, IGHV3, IGHV1-46, IGHV3-7, IGHV1, or IGHV1-8. In some instances, the gene is IGHV1-69 and IGHV3-30. In some instances, the region of the antibody for variation is IGHJ3, IGHJ6, IGHJ, IGHJ4, IGHJ5, IGHJ2, or IGH1. In some instances, the region of the antibody for variation is IGHJ3, IGHJ6, IGHJ, or IGHJ4. In some instances, the at least one region of the antibody for variation is IGHV1-69, IGHV3-23, IGKV3-20, IGKV1-39, or combinations thereof. In some instances, the at least one region of the antibody for variation is IGHV1-69 and IGKV3-20, In some instances, the at least one region of the antibody for variation is IGHV1-69 and IGKV1-39. In some instances, the at least one region of the antibody for variation is IGHV3-23 and IGKV3-20. In some instances, the at least one region of the antibody for variation is IGHV3-23 and IGKV1-39.

Provided herein are libraries comprising nucleic acids encoding for antibodies, wherein the libraries are synthesized with various numbers of fragments. In some instances, the fragments comprise the CDRH1, CDRH2, CDRH3, CDRL1, CDRL2, CDRL3, VL, or VH domain. In some instances, the fragments comprise framework element 1 (FW1), framework element 2 (FW2), framework element 3 (FW3), or framework element 4 (FW4). In some instances, the antibody libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

Libraries comprising nucleic acids encoding for antibodies as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the antibodies comprise at least or about 100, 200, 300, 400, 500, 600, 700, 800, 900, 1000, 2000, 3000, 4000, 5000, or more than 5000 amino acids.

A number of variant sequences for the at least one region of the antibody for variation are de novo synthesized using methods as described herein. In some instances, a number of variant sequences is de novo synthesized for CDRH1, CDRH2, CDRH3, CDRL1, CDRL2, CDRL3, VL, VH, or combinations thereof. In some instances, a number of variant sequences is de novo synthesized for framework element 1 (FW1), framework element 2 (FW2), framework element 3 (FW3), or framework element 4 (FW4). The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is at least or about 500, 600, 700, 800, 900, 1000, 2000, 3000, 4000, 5000, 6000, 7000, 8000, or more than 8000 sequences. In some instances, the number of variant sequences is about 10 to 500, 25 to 475, 50 to 450, 75 to 425, 100 to 400, 125 to 375, 150 to 350, 175 to 325, 200 to 300, 225 to 375, 250 to 350, or 275 to 325 sequences.

Variant sequences for the at least one region of the antibody, in some instances, vary in length or sequence. In some instances, the at least one region that is de novo synthesized is for CDRH1, CDRH2, CDRH3, CDRL1, CDRL2, CDRL3, VL, VH, or combinations thereof. In some instances, the at least one region that is de novo synthesized is for framework element 1 (FW1), framework element 2 (FW2), framework element 3 (FW3), or framework element 4 (FW4). In some instances, the variant sequence comprises at least or about 1, 2, 3, 4, 5, 6, 7, 8, 9, 10, 15, 20, 25, 30, 35, 40, 45, 50, or more than 50 variant nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 additional nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 less nucleotides or amino acids as compared to wild-type. In some instances, the libraries comprise at least or about $10^1$, $10^2$, $10^3$, $10^4$, $10^5$, $10^6$, $10^7$, $10^8$, $10^9$, $10^{10}$, or more than $10^{10}$ variants.

Following synthesis of antibody libraries, antibody libraries may be used for screening and analysis. For example, antibody libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, antibody libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis. In some instances, antibody libraries are displayed on the surface of a cell or phage. In some instances, antibody libraries are enriched for sequences with a desired activity using phage display.

In some instances, the antibody libraries are assayed for functional activity, structural stability (e.g., thermal stable or pH stable), expression, specificity, or a combination thereof. In some instances, the antibody libraries are assayed for antibody capable of folding. In some instances, a region of the antibody is assayed for functional activity, structural stability, expression, specificity, folding, or a combination thereof. For example, a VH region or VL region is assayed for functional activity, structural stability, expression, specificity, folding, or a combination thereof.

In some instances, the affinity of antibodies or IgGs generated by methods as described herein is at least or about 1.5×, 2.0×, 5×, 10×, 20×, 30×, 40×, 50×, 60×, 70×, 80×, 90×, 100×, 200×, or more than 200× improved binding affinity as compared to a comparator antibody. In some instances, the affinity of antibodies or IgGs generated by methods as described herein is at least or about 1.5×, 2.0×, 5×, 10×, 20×, 30×, 40×, 50×, 60×, 70×, 80×, 90×, 100×, 200×, or more than 200× improved function as compared to a comparator antibody. In some instances, the comparator antibody is an antibody with similar structure, sequence, or antigen target.

Expression Systems

Provided herein are libraries comprising nucleic acids encoding for antibody comprising binding domains, wherein the libraries have improved specificity, stability, expression, folding, or downstream activity. In some instances, libraries described herein are used for screening and analysis.

Provided herein are libraries comprising nucleic acids encoding for antibody comprising binding domains, wherein the nucleic acid libraries are used for screening and analysis. In some instances, screening and analysis comprises in vitro, in vivo, or ex vivo assays. Cells for screening include primary cells taken from living subjects or cell lines. Cells may be from prokaryotes (e.g., bacteria and fungi) or eukaryotes (e.g., animals and plants). Exemplary animal cells include, without limitation, those from a mouse, rabbit, primate, and insect. In some instances, cells for screening include a cell line including, but not limited to, Chinese Hamster Ovary (CHO) cell line, human embryonic kidney (HEK) cell line, or baby hamster kidney (BHK) cell line. In some instances, nucleic acid libraries described herein may also be delivered to a multicellular organism. Exemplary multicellular organisms include, without limitation, a plant, a mouse, rabbit, primate, and insect.

Nucleic acid libraries described herein may be screened for various pharmacological or pharmacokinetic properties. In some instances, the libraries are screened using in vitro assays, in vivo assays, or ex vivo assays. For example, in vitro pharmacological or pharmacokinetic properties that are screened include, but are not limited to, binding affinity, binding specificity, and binding avidity. Exemplary in vivo pharmacological or pharmacokinetic properties of libraries described herein that are screened include, but are not limited to, therapeutic efficacy, activity, preclinical toxicity properties, clinical efficacy properties, clinical toxicity properties, immunogenicity, potency, and clinical safety properties.

Provided herein are nucleic acid libraries, wherein the nucleic acid libraries may be expressed in a vector. Expression vectors for inserting nucleic acid libraries disclosed herein may comprise eukaryotic or prokaryotic expression vectors. Exemplary expression vectors include, without limitation, mammalian expression vectors: pSF-CMV-NEO-NH2-PPT-3×FLAG, pSF-CMV-NEO-COOH-3×FLAG, pSF-CMV-PURO-NH2-GST-TEV, pSF-OXB20-COOH-TEV-FLAG(R)-6His, pCEP4 pDEST27, pSF-CMV-Ub-KrYFP, pSF-CMV-FMDV-daGFP, pEF1a-mCherry-N1 Vector, pEF1a-tdTomato Vector, pSF-CMV-FMDV-Hygro, pSF-CMV-PGK-Puro, pMCP-tag(m), and pSF-CMV-PURO-NH2-CMYC; bacterial expression vectors: pSF-OXB20-BetaGal, pSF-OXB20-Fluc, pSF-OXB20, and pSF-Tac; plant expression vectors: pRI 101-AN DNA and pCambia2301; and yeast expression vectors: pTYB21 and pKLAC2, and insect vectors: pAc5.1/V5-His A and pDEST8. In some instances, the vector is pcDNA3 or pcDNA3.1.

Described herein are nucleic acid libraries that are expressed in a vector to generate a construct comprising an antibody. In some instances, a size of the construct varies. In some instances, the construct comprises at least or about 500, 600, 700, 800, 900, 1000, 1100, 1300, 1400, 1500, 1600, 1700, 1800, 2000, 2400, 2600, 2800, 3000, 3200, 3400, 3600, 3800, 4000, 4200, 4400, 4600, 4800, 5000, 6000, 7000, 8000, 9000, 10000, or more than 10000 bases. In some instances, a the construct comprises a range of about 300 to 1,000, 300 to 2,000, 300 to 3,000, 300 to 4,000, 300 to 5,000, 300 to 6,000, 300 to 7,000, 300 to 8,000, 300 to 9,000, 300 to 10,000, 1,000 to 2,000, 1,000 to 3,000, 1,000 to 4,000, 1,000 to 5,000, 1,000 to 6,000, 1,000 to 7,000, 1,000 to 8,000, 1,000 to 9,000, 1,000 to 10,000, 2,000 to 3,000, 2,000 to 4,000, 2,000 to 5,000, 2,000 to 6,000, 2,000 to 7,000, 2,000 to 8,000, 2,000 to 9,000, 2,000 to 10,000, 3,000 to 4,000, 3,000 to 5,000, 3,000 to 6,000, 3,000 to 7,000, 3,000 to 8,000, 3,000 to 9,000, 3,000 to 10,000, 4,000 to 5,000, 4,000 to 6,000, 4,000 to 7,000, 4,000 to 8,000, 4,000 to 9,000, 4,000 to 10,000, 5,000 to 6,000, 5,000 to 7,000, 5,000 to 8,000, 5,000 to 9,000, 5,000 to 10,000, 6,000 to 7,000, 6,000 to 8,000, 6,000 to 9,000, 6,000 to 10,000, 7,000 to 8,000, 7,000 to 9,000, 7,000 to 10,000, 8,000 to 9,000, 8,000 to 10,000, or 9,000 to 10,000 bases.

Provided herein are libraries comprising nucleic acids encoding for antibodies, wherein the nucleic acid libraries are expressed in a cell. In some instances, the libraries are synthesized to express a reporter gene. Exemplary reporter genes include, but are not limited to, acetohydroxyacid synthase (AHAS), alkaline phosphatase (AP), beta galactosidase (LacZ), beta glucuronidase (GUS), chloramphenicol acetyltransferase (CAT), green fluorescent protein (GFP), red fluorescent protein (RFP), yellow fluorescent protein (YFP), cyan fluorescent protein (CFP), cerulean fluorescent protein, citrine fluorescent protein, orange fluorescent protein, cherry fluorescent protein, turquoise fluorescent protein, blue fluorescent protein, horseradish peroxidase (HRP), luciferase (Luc), nopaline synthase (NOS), octopine synthase (OCS), luciferase, and derivatives thereof. Methods to determine modulation of a reporter gene are well known in the art, and include, but are not limited to, fluorometric methods (e.g. fluorescence spectroscopy, Fluorescence Activated Cell Sorting (FACS), fluorescence microscopy), and antibiotic resistance determination.

Diseases and Disorders

Provided herein are SARS-CoV-2 or ACE2 binding libraries comprising nucleic acids encoding for antibodies comprising SARS-CoV-2 or ACE2 binding domains may have therapeutic effects. In some instances, the SARS-CoV-2 or ACE2 binding libraries result in protein when translated that is used to treat a disease or disorder. In some instances, the protein is an immunoglobulin. In some instances, the protein is a peptidomimetic. In some instances, the disease or disorder is a viral infection caused by SARS-CoV-2. In some instances, the disease or disorder is a respiratory disease or disorder caused by SARS-CoV-2.

SARS-CoV-2 or ACE2 variant antibody libraries as described herein may be used to treat SARS-CoV-2. In some embodiments, the SARS-CoV-2 or ACE2 variant antibody libraries are used to treat or prevent symptoms of SARS-CoV-2. These symptoms include, but are not limited to, fever, chills, cough, fatigue, headaches, loss of taste, loss of smell, nausea, vomiting, muscle weakness, sleep difficulties, anxiety, and depression. In some embodiments, the SARS-CoV-2 or ACE2 variant antibody libraries are used to treat a subject who has symptoms for an extended period of time. In some embodiments, the subject has symptoms for an extended period of time after testing negative for SARS-CoV-2. In some embodiments, the subject has symptoms for an extended period of time including at least 1 week, 2 weeks, 3 weeks, 1 month, 2 months, 3 months, 4 months, 5 months, 6 months, 7 months, 8 months, 9 months, 10 months, 11 months, 1 year, or more than 1 year.

In some instances, the subject is a mammal. In some instances, the subject is a mouse, rabbit, dog, or human. Subjects treated by methods described herein may be infants, adults, or children. Pharmaceutical compositions comprising antibodies or antibody fragments as described herein may be administered intravenously or subcutaneously. In some instances, a pharmaceutical composition comprises an antibody or antibody fragment described herein comprising a CDRH1 sequence of any one of SEQ ID NOs: 1-50, 779-919, 1344-1523, and 2381-2452. In some instances, a pharmaceutical composition comprises an antibody or antibody fragment described herein comprising a CDRH2 sequence of any one of SEQ ID NOs: 51-100, 920-1061, 1524-1703, and 2453-2524 In some instances, a pharmaceutical composition comprises an antibody or antibody fragment described herein comprising a CDRH3 sequence of any one of SEQ ID NOs: 101-150, 1062-1202, 1704-1883, and 2525-2596. In some instances, a pharmaceutical composition comprises an antibody or antibody fragment described herein comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 151-165, 241-255, 331-357, and 547-575; (b) an amino acid sequence of CDRH2 is as set forth in any one of SEQ ID NOs: 166-180, 256-270, 358-384, and 576-604; (c) an amino acid sequence of CDRH3 is as set forth in any one of SEQ ID NOs: 181-195, 271-285, 385-411, and 605-633; (d) an amino acid sequence of CDRL1 is as set forth in any one of SEQ ID NOs: 196-210, 286-300, 412-438, and 634-662; (e) an amino acid sequence of CDRL2 is as set forth in any one of SEQ ID NOs: 211-225, 301-315, 439-465, and 663-691; and (f) an amino acid sequence of CDRL3 is as set forth in any one of SEQ ID NOs: 226-240, 316-330, 466-492, and 692-720. In some instances, a pharmaceutical composition comprises an antibody or antibody fragment described herein comprising a VH comprising at least or about 70%, 80%, 85%, 90%, 91%, 92%, 93%, 94%, 95%, 96%, 97%, 98%, 99%, or 100% sequence identity to any one of SEQ ID NOs: 493-519 and 721-749, and VL comprising at least or about 70%, 80%, 85%, 90%, 91%, 92%, 93%, 94%, 95%, 96%, 97%, 98%, 99%, or 100% sequence identity to any one of SEQ ID NOs: 520-546 and 750-778. In some instances, a pharmaceutical composition comprises an antibody or antibody fragment described herein comprising a heavy chain variable domain comprising at least or about 70%, 80%, 85%, 90%, 91%, 92%, 93%, 94%, 95%, 96%, 97%, 98%, 99%, or 100% sequence identity to any one of SEQ ID NOs: 1918-2058, 2599-2778, and 3095-3173.

SARS-CoV-2 or ACE2 antibodies as described herein may confer immunity after exposure to SARS-CoV-2 or ACE2 antibodies. In some embodiments, the SARS-CoV-2 or ACE2 antibodies described herein are used for passive immunization of a subject. In some instances, the subject is actively immunized after exposure to SARS-CoV-2 or ACE2 antibodies followed by exposure to SARS-CoV-2. In some embodiments, SARS-CoV-2 or ACE2 antibodies are derived from a subject who has recovered from SARS-CoV-2.

In some embodiments, the immunity occurs at least about 30 minutes, 1 hour, 5 hours, 10 hours, 16 hours, 20 hours, 24 hours, 2 days, 3 days, 4 days, 5 days, 6 days, 1 week, 2 weeks, or more than 2 weeks after exposure to SARS-CoV-2 or ACE2 antibodies. In some instances, the immunity lasts for at least about 1 day, 2 days, 3 days, 4 days, 5 days, 6 days, 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, or more than 5 years after exposure to SARS-CoV-2 or ACE2 antibodies.

In some embodiments, the subject receives the SARS-CoV-2 or ACE2 antibodies prior to exposure to SARS-CoV-2. In some embodiments, the subject receives the SARS-CoV-2 or ACE2 antibodies at least about 30 minutes, 1 hour, 4 hours, 8 hours, 12 hours, 16 hours, 20 hours, 1 day, 2 days, 3 days, 4 days, 5 days, 6 days, 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, or more than 5 years prior to exposure to SARS-CoV-2. In some embodiments, the subject receives the SARS-CoV-2 or ACE2 antibodies after exposure to SARS-CoV-2. In some embodiments, the subject receives the SARS-CoV-2 or ACE2 antibodies at least about 30 minutes, 1 hour, 4 hours, 8 hours, 12 hours, 16 hours, 20 hours, 1 day, 2 days, 3 days, 4 days, 5 days, 6 days, 1 week, 2 weeks, 3 weeks, 1 month, 2 months, 3 months, 4 months, 5 months, 6 months, 7 months, 8 months, 9 months, 10 months, 11 months, 1 year, 2 years, 3 years, 4 years, 5 years, or more than 5 years after exposure to SARS-CoV-2.

SARS-CoV-2 or ACE2 antibodies described herein may be administered through various routes. The administration may, depending on the composition being administered, for example, be oral, pulmonary, intravenous, intraperitoneal, intramuscular, intracavity, subcutaneous, or transdermal.

Described herein are compositions or pharmaceutical compositions comprising SARS-CoV-2 or ACE2 antibodies or antibody fragment thereof that comprise various dosages of the antibodies or antibody fragment. In some instances, the dosage is ranging from about 1 to 25 mg/kg, from about 1 to 50 mg/kg, from about 1 to 80 mg/kg, from about 1 to about 100 mg/kg, from about 5 to about 100 mg/kg, from about 5 to about 80 mg/kg, from about 5 to about 60 mg/kg, from about 5 to about 50 mg/kg or from about 5 to about 500 mg/kg which can be administered in single or multiple doses. In some instances, the dosage is administered in an amount of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, about 105 mg/kg, about 110 mg/kg, about 115 mg/kg, about 120, about 125, about 130, about 135, about 140, about 145, about 150, about 155, about 160, about 165, about 170, about 175, about 180, about 185, about 190, about 195, about 200, about 205, about 210, about 215, about 220, about 225, about 230, about 240, about 250, about 260, about 270, about 275, about 280, about 290, about 300, about 310, about 320, about 330, about 340, about 350, about 360 mg/kg, about 370 mg/kg, about 380 mg/kg, about 390 mg/kg, about 400 mg/kg, 410 mg/kg, about 420 mg/kg, about 430 mg/kg, about 440 mg/kg, about 450 mg/kg, about 460 mg/kg, about 470 mg/kg, about 480 mg/kg, about 490 mg/kg, or about 500 mg/kg.

SARS-CoV-2 or ACE2 antibodies or antibody fragment thereof described herein, in some embodiments, improve disease severity. In some embodiments, the SARS-CoV-2 or ACE2 antibodies or antibody fragment thereof improve disease severity at a dose level of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, or about 20 mg/kg. In some embodiments, the SARS-CoV-2 or ACE2 antibodies or antibody fragment thereof improve disease severity at a dose level of about 1 mg/kg, about 5 mg/kg, or about 10 mg/kg. In some embodiments, disease severity is determined by percent weight loss. In some embodiments, the SARS-CoV-2 or ACE2 antibodies or antibody fragment thereof protects against weight loss at a dose level of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, or about 20 mg/kg. In some embodiments, the SARS-CoV-2 or ACE2 antibodies or antibody fragment thereof protects against weight loss at a dose level of about 1 mg/kg, about 5 mg/kg, or about 10 mg/kg. In some embodiments, SARS-CoV-2 or ACE2 antibodies or antibody fragment thereof Variant Libraries Codon Variation Variant nucleic acid libraries described herein may comprise a plurality of nucleic acids, wherein each nucleic acid encodes for a variant codon sequence compared to a reference nucleic acid sequence. In some instances, each nucleic acid of a first nucleic acid population contains a variant at a single variant site. In some instances, the first nucleic acid population contains a plurality of variants at a single variant site such that the first nucleic acid population contains more than one variant at the same variant site. The first nucleic acid population may comprise nucleic acids collectively encoding multiple codon variants at the same variant site. The first nucleic acid population may comprise nucleic acids collectively encoding up to 19 or more codons at the same position. The first nucleic acid population may comprise nucleic acids collectively encoding up to 60 variant triplets at the same position, or the first nucleic acid population may comprise nucleic acids collectively encoding up to 61 different triplets of codons at the same position. Each variant may encode for a codon that results in a different amino acid during translation. Table 1 provides a listing of each codon possible (and the representative amino acid) for a variant site.

TABLE 1

List of codons and amino acids

| Amino Acids | One letter code | Three letter code | Codons | | | | | |
|---|---|---|---|---|---|---|---|---|
| Alanine | A | Ala | GCA | GCC | GCG | GCT | | |
| Cysteine | C | Cys | TGC | | | TGT | | |
| Aspartic acid | D | Asp | GAC | | | GAT | | |
| Glutamic acid | E | Glu | GAA | | | GAG | | |
| Phenylalanine | F | Phe | TTC | | | TTT | | |
| Glycine | G | Gly | GGA | GGC | GGG | GGT | | |
| Histidine | H | His | CAC | | | CAT | | |
| Isoleucine | I | Iso | ATA | ATC | | ATT | | |
| Lysine | K | Lys | AAA | | | AAG | | |
| Leucine | L | Leu | TTA | TTG | CTA | CTC | CTG | CTT |
| Methionine | M | Met | | | ATG | | | |
| Asparagine | N | Asn | AAC | | | AAT | | |
| Proline | P | Pro | CCA | CCC | CCG | CCT | | |
| Glutamine | Q | Gln | CAA | | | CAG | | |
| Arginine | R | Arg | AGA | AGG | CGA | CGC | CGG | CGT |
| Serine | S | Ser | AGC | AGT | TCA | TCC | TCG | TCT |
| Threonine | T | Thr | ACA | ACC | ACG | ACT | | |
| Valine | V | Val | GTA | GTC | GTG | GTT | | |
| Tryptophan | W | Trp | | | TGG | | | |
| Tyrosine | Y | Tyr | TAC | | | TAT | | |

A nucleic acid population may comprise varied nucleic acids collectively encoding up to 20 codon variations at multiple positions. In such cases, each nucleic acid in the population comprises variation for codons at more than one position in the same nucleic acid. In some instances, each nucleic acid in the population comprises variation for codons at 1, 2, 3, 4, 5, 6, 7, 8, 9, 10, 11, 12, 13, 14, 15, 16, 17, 18, 19, 20 or more codons in a single nucleic acid. In some instances, each variant long nucleic acid comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single long nucleic acid. In some instances, the variant nucleic acid population comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single nucleic acid. In some instances, the variant nucleic acid population comprises variation for codons in at least about 10, 20, 30, 40, 50, 60, 70, 80, 90, 100 or more codons in a single long nucleic acid.

Highly Parallel Nucleic Acid Synthesis

Provided herein is a platform approach utilizing miniaturization, parallelization, and vertical integration of the end-to-end process from polynucleotide synthesis to gene assembly within nanowells on silicon to create a revolutionary synthesis platform. Devices described herein provide, with the same footprint as a 96-well plate, a silicon synthesis platform is capable of increasing throughput by a factor of up to 1,000 or more compared to traditional synthesis methods, with production of up to approximately 1,000,000 or more polynucleotides, or 10,000 or more genes in a single highly-parallelized run.

With the advent of next-generation sequencing, high resolution genomic data has become an important factor for studies that delve into the biological roles of various genes in both normal biology and disease pathogenesis. At the core of this research is the central dogma of molecular biology and the concept of "residue-by-residue transfer of sequential information." Genomic information encoded in the DNA is transcribed into a message that is then translated into the protein that is the active product within a given biological pathway.

Another exciting area of study is on the discovery, development and manufacturing of therapeutic molecules focused on a highly-specific cellular target. High diversity DNA sequence libraries are at the core of development pipelines for targeted therapeutics. Gene variants are used to express proteins in a design, build, and test protein engineering cycle that ideally culminates in an optimized gene for high expression of a protein with high affinity for its therapeutic target. As an example, consider the binding pocket of a receptor. The ability to test all sequence permutations of all residues within the binding pocket simultaneously will allow for a thorough exploration, increasing chances of success. Saturation mutagenesis, in which a researcher attempts to generate all possible mutations or variants at a specific site within the receptor, represents one approach to this development challenge. Though costly and time and labor-intensive, it enables each variant to be introduced into each position. In contrast, combinatorial mutagenesis, where a few selected positions or short stretch of DNA may be modified extensively, generates an incomplete repertoire of variants with biased representation.

To accelerate the drug development pipeline, a library with the desired variants available at the intended frequency in the right position available for testing—in other words, a precision library, enables reduced costs as well as turnaround time for screening. Provided herein are methods for synthesizing nucleic acid synthetic variant libraries which provide for precise introduction of each intended variant at the desired frequency. To the end user, this translates to the ability to not only thoroughly sample sequence space but also be able to query these hypotheses in an efficient manner, reducing cost and screening time. Genome-wide editing can elucidate important pathways, libraries where each variant and sequence permutation can be tested for optimal functionality, and thousands of genes can be used to reconstruct entire pathways and genomes to re-engineer biological systems for drug discovery.

Ina first example, a drug itself can be optimized using methods described herein. For example, to improve a specified function of an antibody, a variant polynucleotide library encoding for a portion of the antibody is designed and synthesized. A variant nucleic acid library for the antibody can then be generated by processes described herein (e.g., PCR mutagenesis followed by insertion into a vector). The antibody is then expressed in a production cell line and screened for enhanced activity. Example screens include examining modulation in binding affinity to an antigen, stability, or effector function (e.g., ADCC, complement, or apoptosis). Exemplary regions to optimize the antibody include, without limitation, the Fc region, Fab region, variable region of the Fab region, constant region of the Fab region, variable domain of the heavy chain or light chain ($V_H$ or $V_L$), and specific complementarity-determining regions (CDRs) of $V_H$ or VL.

Nucleic acid libraries synthesized by methods described herein may be expressed in various cells associated with a disease state. Cells associated with a disease state include cell lines, tissue samples, primary cells from a subject, cultured cells expanded from a subject, or cells in a model system. Exemplary model systems include, without limitation, plant and animal models of a disease state.

To identify a variant molecule associated with prevention, reduction or treatment of a disease state, a variant nucleic acid library described herein is expressed in a cell associated with a disease state, or one in which a cell a disease state can be induced. In some instances, an agent is used to induce a disease state in cells. Exemplary tools for disease state induction include, without limitation, a Cre/Lox recombination system, LPS inflammation induction, and streptozotocin to induce hypoglycemia. The cells associated with a disease state may be cells from a model system or cultured cells, as well as cells from a subject having a particular disease condition. Exemplary disease conditions include a bacterial, fungal, viral, autoimmune, or proliferative disorder (e.g., cancer). In some instances, the variant nucleic acid library is expressed in the model system, cell line, or primary cells derived from a subject, and screened for changes in at least one cellular activity. Exemplary cellular activities include, without limitation, proliferation, cycle progression, cell death, adhesion, migration, reproduction, cell signaling, energy production, oxygen utilization, metabolic activity, and aging, response to free radical damage, or any combination thereof Substrates Devices used as a surface for polynucleotide synthesis may be in the form of substrates which include, without limitation, homogenous array surfaces, patterned array surfaces, channels, beads, gels, and the like. Provided herein are substrates comprising a plurality of clusters, wherein each cluster comprises a plurality of loci that support the attachment and synthesis of polynucleotides. In some instances, substrates comprise a homogenous array surface. For example, the homogenous array surface is a homogenous plate. The term "locus" as used herein refers to a discrete region on a structure which provides support for polynucleotides encoding for a single predetermined sequence to extend from the surface. In some instances, a locus is on a two dimensional surface, e.g., a substantially planar surface. In some instances, a locus is on a three-dimensional surface, e.g., a well, microwell, channel, or post. In some instances, a surface of a locus comprises a material that is actively functionalized to attach to at least one nucleotide for polynucleotide synthesis, or preferably, a population of identical nucleotides for synthesis of a population of polynucleotides. In some instances, polynucleotide refers to a population of polynucleotides encoding for the same nucleic acid sequence. In some cases, a surface of a substrate is inclusive of one or a plurality of surfaces of a substrate. The average error rates for polynucleotides synthesized within a library described here using the systems and methods provided are often less than 1 in 1000, less than about 1 in 2000, less than about 1 in 3000 or less often without error correction.

Provided herein are surfaces that support the parallel synthesis of a plurality of polynucleotides having different predetermined sequences at addressable locations on a common support. In some instances, a substrate provides support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more non-identical polynucleotides. In some cases, the surfaces provide support for the synthesis of more than 50, 100, 200, 400, 600, 800, 1000, 1200, 1400, 1600, 1800, 2,000; 5,000; 10,000; 20,000; 50,000; 100,000; 200, 000; 300,000; 400,000; 500,000; 600,000; 700,000; 800, 000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more polynucleotides encoding for distinct sequences. In some instances, at least a portion of the polynucleotides have an identical sequence or are configured to be synthesized with an identical sequence. In some instances, the substrate provides a surface environment for the growth of polynucleotides having at least 80, 90, 100, 120, 150, 175, 200, 225, 250, 275, 300, 325, 350, 375, 400, 425, 450, 475, 500 bases or more.

Provided herein are methods for polynucleotide synthesis on distinct loci of a substrate, wherein each locus supports the synthesis of a population of polynucleotides. In some cases, each locus supports the synthesis of a population of polynucleotides having a different sequence than a population of polynucleotides grown on another locus. In some instances, each polynucleotide sequence is synthesized with 1, 2, 3, 4, 5, 6, 7, 8, 9 or more redundancy across different loci within the same cluster of loci on a surface for polynucleotide synthesis. In some instances, the loci of a substrate are located within a plurality of clusters. In some instances, a substrate comprises at least 10, 500, 1000, 2000, 3000, 4000, 5000, 6000, 7000, 8000, 9000, 10000, 11000, 12000, 13000, 14000, 15000, 20000, 30000, 40000, 50000 or more clusters. In some instances, a substrate comprises more than 2,000; 5,000; 10,000; 100,000; 200,000; 300,000; 400,000; 500,000; 600,000; 700,000; 800,000; 900,000; 1,000,000; 1,100,000; 1,200,000; 1,300,000; 1,400,000; 1,500,000; 1,600,000; 1,700,000; 1,800,000; 1,900,000; 2,000,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; or 10,000,000 or more distinct loci. In some instances, a substrate comprises about 10,000 distinct loci. The amount of loci within a single cluster is varied in different instances. In some cases, each cluster includes 1, 2, 3, 4, 5, 6, 7, 8, 9, 10, 20, 30, 40, 50, 60, 70, 80, 90, 100, 120, 130, 150, 200, 300, 400, 500 or more loci. In some instances, each cluster includes about 50-500 loci. In some instances, each cluster includes about 100-200 loci. In some instances, each cluster includes about 100-150 loci. In some instances, each cluster includes about 109, 121, 130 or 137 loci. In some instances, each cluster includes about 19, 20, 61, 64 or more loci. Alternatively or in combination, polynucleotide synthesis occurs on a homogenous array surface.

In some instances, the number of distinct polynucleotides synthesized on a substrate is dependent on the number of distinct loci available in the substrate. In some instances, the density of loci within a cluster or surface of a substrate is at least or about 1, 10, 25, 50, 65, 75, 100, 130, 150, 175, 200, 300, 400, 500, 1,000 or more loci per mm$^2$. In some cases, a substrate comprises 10-500, 25-400, 50-500, 100-500, 150-500, 10-250, 50-250, 10-200, or 50-200 mm$^2$. In some instances, the distance between the centers of two adjacent loci within a cluster or surface is from about 10-500, from about 10-200, or from about 10-100 um. In some instances, the distance between two centers of adjacent loci is greater than about 10, 20, 30, 40, 50, 60, 70, 80, 90 or 100 um. In some instances, the distance between the centers of two adjacent loci is less than about 200, 150, 100, 80, 70, 60, 50, 40, 30, 20 or 10 um. In some instances, each locus has a width of about 0.5, 1, 2, 3, 4, 5, 6, 7, 8, 9, 10, 20, 30, 40, 50, 60, 70, 80, 90 or 100 um. In some cases, each locus has a width of about 0.5-100, 0.5-50, 10-75, or 0.5-50 um.

In some instances, the density of clusters within a substrate is at least or about 1 cluster per 100 mm$^2$, 1 cluster per 10 mm$^2$, 1 cluster per 5 mm$^2$, 1 cluster per 4 mm$^2$, 1 cluster per 3 mm$^2$, 1 cluster per 2 mm$^2$, 1 cluster per 1 mm$^2$, 2 clusters per 1 mm$^2$, 3 clusters per 1 mm$^2$, 4 clusters per 1 mm$^2$, 5 clusters per 1 mm$^2$, 10 clusters per 1 mm$^2$, 50 clusters per 1 mm$^2$ or more. In some instances, a substrate comprises from about 1 cluster per 10 mm$^2$ to about 10 clusters per 1 mm$^2$. In some instances, the distance between the centers of two adjacent clusters is at least or about 50, 100, 200, 500, 1000, 2000, or 5000 um. In some cases, the distance between the centers of two adjacent clusters is between about 50-100, 50-200, 50-300, 50-500, and 100-2000 um. In some cases, the distance between the centers of two adjacent clusters is between about 0.05-50, 0.05-10, 0.05-5, 0.05-4, 0.05-3, 0.05-2, 0.1-10, 0.2-10, 0.3-10, 0.4-10, 0.5-10, 0.5-5, or 0.5-2 mm. In some cases, each cluster has a cross section of about 0.5 to about 2, about 0.5 to about 1, or about 1 to about 2 mm. In some cases, each cluster has a cross section of about 0.5, 0.6, 0.7, 0.8, 0.9, 1, 1.1, 1.2, 1.3, 1.4, 1.5, 1.6, 1.7, 1.8, 1.9 or 2 mm. In some cases, each cluster has an interior cross section of about 0.5, 0.6, 0.7, 0.8, 0.9, 1, 1.1, 1.15, 1.2, 1.3, 1.4, 1.5, 1.6, 1.7, 1.8, 1.9 or 2 mm.

In some instances, a substrate is about the size of a standard 96 well plate, for example between about 100 and about 200 mm by between about 50 and about 150 mm. In some instances, a substrate has a diameter less than or equal to about 1000, 500, 450, 400, 300, 250, 200, 150, 100 or 50 mm. In some instances, the diameter of a substrate is between about 25-1000, 25-800, 25-600, 25-500, 25-400, 25-300, or 25-200 mm. In some instances, a substrate has a planar surface area of at least about 100; 200; 500; 1,000; 2,000; 5,000; 10,000; 12,000; 15,000; 20,000; 30,000; 40,000; 50,000 mm$^2$ or more. In some instances, the thickness of a substrate is between about 50-2000, 50-1000, 100-1000, 200-1000, or 250-1000 mm.

Surface Materials

Substrates, devices, and reactors provided herein are fabricated from any variety of materials suitable for the methods, compositions, and systems described herein. In certain instances, substrate materials are fabricated to exhibit a low level of nucleotide binding. In some instances, substrate materials are modified to generate distinct surfaces that exhibit a high level of nucleotide binding. In some instances, substrate materials are transparent to visible and/or UV light. In some instances, substrate materials are sufficiently conductive, e.g., are able to form uniform electric fields across all or a portion of a substrate. In some instances, conductive materials are connected to an electric ground. In some instances, the substrate is heat conductive or insulated. In some instances, the materials are chemical resistant and heat resistant to support chemical or biochemical reactions, for example polynucleotide synthesis reaction processes. In some instances, a substrate comprises flexible materials. For flexible materials, materials can include, without limitation: nylon, both modified and unmodified, nitrocellulose, polypropylene, and the like. In some instances, a substrate comprises rigid materials. For rigid materials, materials can include, without limitation: glass; fuse silica; silicon, plastics (for example polytetrafluoroethylene, polypropylene, polystyrene, polycarbonate, and blends thereof, and the like); metals (for example, gold, platinum, and the like). The substrate, solid support or reactors can be fabricated from a material selected from the group consisting of silicon, polystyrene, agarose, dextran, cellulosic polymers, polyacrylamides, polydimethylsiloxane (PDMS), and glass. The substrates/solid supports or the microstructures, reactors therein may be manufactured with a combination of materials listed herein or any other suitable material known in the art.

Surface Architecture

Provided herein are substrates for the methods, compositions, and systems described herein, wherein the substrates have a surface architecture suitable for the methods, compositions, and systems described herein. In some instances, a substrate comprises raised and/or lowered features. One benefit of having such features is an increase in surface area to support polynucleotide synthesis. In some instances, a substrate having raised and/or lowered features is referred to as a three-dimensional substrate. In some cases, a three-dimensional substrate comprises one or more channels. In some cases, one or more loci comprise a channel. In some cases, the channels are accessible to reagent deposition via a deposition device such as a material deposition device. In some cases, reagents and/or fluids collect in a larger well in fluid communication one or more channels. For example, a substrate comprises a plurality of channels corresponding to a plurality of loci with a cluster, and the plurality of channels are in fluid communication with one well of the cluster. In some methods, a library of polynucleotides is synthesized in a plurality of loci of a cluster.

Provided herein are substrates for the methods, compositions, and systems described herein, wherein the substrates are configured for polynucleotide synthesis. In some instances, the structure is configured to allow for controlled flow and mass transfer paths for polynucleotide synthesis on a surface. In some instances, the configuration of a substrate allows for the controlled and even distribution of mass transfer paths, chemical exposure times, and/or wash efficacy during polynucleotide synthesis. In some instances, the configuration of a substrate allows for increased sweep efficiency, for example by providing sufficient volume for a growing polynucleotide such that the excluded volume by the growing polynucleotide does not take up more than 50, 45, 40, 35, 30, 25, 20, 15, 14, 13, 12, 11, 10, 9, 8, 7, 6, 5, 4, 3, 2, 1%, or less of the initially available volume that is available or suitable for growing the polynucleotide. In some instances, a three-dimensional structure allows for managed flow of fluid to allow for the rapid exchange of chemical exposure.

Provided herein are substrates for the methods, compositions, and systems described herein, wherein the substrates comprise structures suitable for the methods, compositions, and systems described herein. In some instances, segregation is achieved by physical structure. In some instances, segregation is achieved by differential functionalization of the surface generating active and passive regions for polynucleotide synthesis. In some instances, differential functionalization is achieved by alternating the hydrophobicity across the substrate surface, thereby creating water contact angle effects that cause beading or wetting of the deposited reagents. Employing larger structures can decrease splashing and cross-contamination of distinct polynucleotide synthesis locations with reagents of the neighboring spots. In some cases, a device, such as a material deposition device, is used to deposit reagents to distinct polynucleotide synthesis locations. Substrates having three-dimensional features are configured in a manner that allows for the synthesis of a large number of polynucleotides (e.g., more than about 10,000) with a low error rate (e.g., less than about 1:500, 1:1000, 1:1500, 1:2,000, 1:3,000, 1:5,000, or 1:10,000). In some cases, a substrate comprises features with a density of about or greater than about 1, 5, 10, 20, 30, 40, 50, 60, 70, 80, 100, 110, 120, 130, 140, 150, 160, 170, 180, 190, 200, 300, 400 or 500 features per $mm^2$.

A well of a substrate may have the same or different width, height, and/or volume as another well of the substrate. A channel of a substrate may have the same or different width, height, and/or volume as another channel of the substrate. In some instances, the diameter of a cluster or the diameter of a well comprising a cluster, or both, is between about 0.05-50, 0.05-10, 0.05-5, 0.05-4, 0.05-3, 0.05-2, 0.05-1, 0.05-0.5, 0.05-0.1, 0.1-10, 0.2-10, 0.3-10, 0.4-10, 0.5-10, 0.5-5, or 0.5-2 mm. In some instances, the diameter of a cluster or well or both is less than or about 5, 4, 3, 2, 1, 0.5, 0.1, 0.09, 0.08, 0.07, 0.06, or 0.05 mm. In some instances, the diameter of a cluster or well or both is between about 1.0 and 1.3 mm. In some instances, the diameter of a cluster or well, or both is about 1.150 mm. In some instances, the diameter of a cluster or well, or both is about 0.08 mm. The diameter of a cluster refers to clusters within a two-dimensional or three-dimensional substrate.

In some instances, the height of a well is from about 20-1000, 50-1000, 100-1000, 200-1000, 300-1000, 400-1000, or 500-1000 um. In some cases, the height of a well is less than about 1000, 900, 800, 700, or 600 um.

In some instances, a substrate comprises a plurality of channels corresponding to a plurality of loci within a cluster, wherein the height or depth of a channel is 5-500, 5-400, 5-300, 5-200, 5-100, 5-50, or 10-50 um. In some cases, the height of a channel is less than 100, 80, 60, 40, or 20 um.

In some instances, the diameter of a channel, locus (e.g., in a substantially planar substrate) or both channel and locus (e.g., in a three-dimensional substrate wherein a locus corresponds to a channel) is from about 1-1000, 1-500, 1-200, 1-100, 5-100, or 10-100 um, for example, about 90, 80, 70, 60, 50, 40, 30, 20 or 10 um. In some instances, the diameter of a channel, locus, or both channel and locus is less than about 100, 90, 80, 70, 60, 50, 40, 30, 20 or 10 um. In some instances, the distance between the center of two adjacent channels, loci, or channels and loci is from about 1-500, 1-200, 1-100, 5-200, 5-100, 5-50, or 5-30, for example, about 20 um.

Surface Modifications

Provided herein are methods for polynucleotide synthesis on a surface, wherein the surface comprises various surface modifications. In some instances, the surface modifications are employed for the chemical and/or physical alteration of a surface by an additive or subtractive process to change one or more chemical and/or physical properties of a substrate surface or a selected site or region of a substrate surface. For example, surface modifications include, without limitation, (1) changing the wetting properties of a surface, (2) functionalizing a surface, i.e., providing, modifying or substituting surface functional groups, (3) defunctionalizing a surface, i.e., removing surface functional groups, (4) otherwise altering the chemical composition of a surface, e.g., through etching, (5) increasing or decreasing surface roughness, (6) providing a coating on a surface, e.g., a coating that exhibits wetting properties that are different from the wetting properties of the surface, and/or (7) depositing particulates on a surface.

In some cases, the addition of a chemical layer on top of a surface (referred to as adhesion promoter) facilitates structured patterning of loci on a surface of a substrate. Exemplary surfaces for application of adhesion promotion include, without limitation, glass, silicon, silicon dioxide and silicon nitride. In some cases, the adhesion promoter is a chemical with a high surface energy. In some instances, a second chemical layer is deposited on a surface of a substrate. In some cases, the second chemical layer has a low surface energy. In some cases, surface energy of a chemical layer coated on a surface supports localization of droplets on the surface. Depending on the patterning arrangement selected, the proximity of loci and/or area of fluid contact at the loci are alterable.

In some instances, a substrate surface, or resolved loci, onto which nucleic acids or other moieties are deposited, e.g., for polynucleotide synthesis, are smooth or substantially planar (e.g., two-dimensional) or have irregularities, such as raised or lowered features (e.g., three-dimensional features). In some instances, a substrate surface is modified with one or more different layers of compounds. Such modification layers of interest include, without limitation, inorganic and organic layers such as metals, metal oxides, polymers, small organic molecules and the like.

In some instances, resolved loci of a substrate are functionalized with one or more moieties that increase and/or decrease surface energy. In some cases, a moiety is chemically inert. In some cases, a moiety is configured to support a desired chemical reaction, for example, one or more processes in a polynucleotide synthesis reaction. The surface energy, or hydrophobicity, of a surface is a factor for determining the affinity of a nucleotide to attach onto the surface. In some instances, a method for substrate functionalization comprises: (a) providing a substrate having a surface that comprises silicon dioxide; and (b) silanizing the surface using, a suitable silanizing agent described herein or otherwise known in the art, for example, an organofunctional alkoxysilane molecule. Methods and functionalizing agents are described in U.S. Pat. No. 5,474,796, which is herein incorporated by reference in its entirety.

In some instances, a substrate surface is functionalized by contact with a derivatizing composition that contains a mixture of silanes, under reaction conditions effective to couple the silanes to the substrate surface, typically via reactive hydrophilic moieties present on the substrate surface. Silanization generally covers a surface through self-assembly with organofunctional alkoxysilane molecules. A variety of siloxane functionalizing reagents can further be used as currently known in the art, e.g., for lowering or increasing surface energy. The organofunctional alkoxysilanes are classified according to their organic functions.

Polynucleotide Synthesis

Methods of the current disclosure for polynucleotide synthesis may include processes involving phosphoramidite chemistry. In some instances, polynucleotide synthesis comprises coupling a base with phosphoramidite. Polynucleotide synthesis may comprise coupling a base by deposition of phosphoramidite under coupling conditions, wherein the same base is optionally deposited with phosphoramidite more than once, i.e., double coupling. Polynucleotide synthesis may comprise capping of unreacted sites. In some instances, capping is optional. Polynucleotide synthesis may also comprise oxidation or an oxidation step or oxidation steps. Polynucleotide synthesis may comprise deblocking, detritylation, and sulfurization. In some instances, polynucleotide synthesis comprises either oxidation or sulfurization. In some instances, between one or each step during a polynucleotide synthesis reaction, the device is washed, for example, using tetrazole or acetonitrile. Time frames for any one step in a phosphoramidite synthesis method may be less than about 2 min, 1 min, 50 sec, 40 sec, 30 sec, 20 sec and 10 sec.

Polynucleotide synthesis using a phosphoramidite method may comprise a subsequent addition of a phosphoramidite building block (e.g., nucleoside phosphoramidite) to a growing polynucleotide chain for the formation of a phosphite triester linkage. Phosphoramidite polynucleotide synthesis proceeds in the 3' to 5' direction. Phosphoramidite polynucleotide synthesis allows for the controlled addition of one nucleotide to a growing nucleic acid chain per synthesis cycle. In some instances, each synthesis cycle comprises a coupling step. Phosphoramidite coupling involves the formation of a phosphite triester linkage between an activated nucleoside phosphoramidite and a nucleoside bound to the substrate, for example, via a linker. In some instances, the nucleoside phosphoramidite is provided to the device activated. In some instances, the nucleoside phosphoramidite is provided to the device with an activator. In some instances, nucleoside phosphoramidites are provided to the device in a 1.5, 2, 3, 4, 5, 6, 7, 8, 9, 10, 11, 12, 13, 14, 15, 16, 17, 18, 19, 20, 25, 30, 35, 40, 50, 60, 70, 80, 90, 100-fold excess or more over the substrate-bound nucleosides. In some instances, the addition of nucleoside phosphoramidite is performed in an anhydrous environment, for example, in anhydrous acetonitrile. Following addition of a nucleoside phosphoramidite, the device is optionally washed. In some instances, the coupling step is repeated one or more additional times, optionally with a wash step between nucleoside phosphoramidite additions to the substrate. In some instances, a polynucleotide synthesis method used herein comprises 1, 2, 3 or more sequential coupling steps. Prior to coupling, in many cases, the nucleoside bound to the device is de-protected by removal of a protecting group, where the protecting group functions to prevent polymerization. A common protecting group is 4,4'-dimethoxytrityl (DMT).

Following coupling, phosphoramidite polynucleotide synthesis methods optionally comprise a capping step. In a capping step, the growing polynucleotide is treated with a capping agent. A capping step is useful to block unreacted substrate-bound 5'-OH groups after coupling from further chain elongation, preventing the formation of polynucleotides with internal base deletions. Further, phosphoramidites activated with 1H-tetrazole may react, to a small extent, with the O6 position of guanosine. Without being bound by theory, upon oxidation with $I_2$/water, this side product, possibly via O6-N7 migration, may undergo depurination. The apurinic sites may end up being cleaved in the course of the final deprotection of the polynucleotide thus reducing the yield of the full-length product. The O6 modifications may be removed by treatment with the capping reagent prior to oxidation with $I_2$/water. In some instances, inclusion of a capping step during polynucleotide synthesis decreases the error rate as compared to synthesis without capping. As an example, the capping step comprises treating the substrate-bound polynucleotide with a mixture of acetic anhydride and 1-methylimidazole. Following a capping step, the device is optionally washed.

In some instances, following addition of a nucleoside phosphoramidite, and optionally after capping and one or more wash steps, the device bound growing nucleic acid is oxidized. The oxidation step comprises the phosphite triester is oxidized into a tetracoordinated phosphate triester, a protected precursor of the naturally occurring phosphate diester internucleoside linkage. In some instances, oxidation of the growing polynucleotide is achieved by treatment with iodine and water, optionally in the presence of a weak base (e.g., pyridine, lutidine, collidine). Oxidation may be carried out under anhydrous conditions using, e.g. tert-Butyl hydroperoxide or (1S)-(+)-(10-camphorsulfonyl)-oxaziridine (CSO). In some methods, a capping step is performed following oxidation. A second capping step allows for device drying, as residual water from oxidation that may persist can inhibit subsequent coupling. Following oxidation, the device and growing polynucleotide is optionally washed. In some instances, the step of oxidation is substituted with a sulfurization step to obtain polynucleotide phosphorothioates, wherein any capping steps can be performed after the sulfurization. Many reagents are capable of the efficient sulfur transfer, including but not limited to 3-(Dimethylaminomethylidene)amino)-3H-1,2,4-dithiazole-3-thione, DDTT, 3H-1,2-benzodithiol-3-one 1,1-dioxide, also known as Beaucage reagent, and N,N,N'N'-Tetraethylthiuram disulfide (TETD).

In order for a subsequent cycle of nucleoside incorporation to occur through coupling, the protected 5' end of the device bound growing polynucleotide is removed so that the primary hydroxyl group is reactive with a next nucleoside phosphoramidite. In some instances, the protecting group is DMT and deblocking occurs with trichloroacetic acid in dichloromethane. Conducting detritylation for an extended time or with stronger than recommended solutions of acids may lead to increased depurination of solid support-bound polynucleotide and thus reduces the yield of the desired full-length product. Methods and compositions of the disclosure described herein provide for controlled deblocking conditions limiting undesired depurination reactions. In some instances, the device bound polynucleotide is washed after deblocking. In some instances, efficient washing after deblocking contributes to synthesized polynucleotides having a low error rate.

Methods for the synthesis of polynucleotides typically involve an iterating sequence of the following steps: application of a protected monomer to an actively functionalized surface (e.g., locus) to link with either the activated surface, a linker or with a previously deprotected monomer; deprotection of the applied monomer so that it is reactive with a subsequently applied protected monomer; and application of another protected monomer for linking One or more intermediate steps include oxidation or sulfurization. In some instances, one or more wash steps precede or follow one or all of the steps.

Methods for phosphoramidite-based polynucleotide synthesis comprise a series of chemical steps. In some instances, one or more steps of a synthesis method involve reagent cycling, where one or more steps of the method comprise application to the device of a reagent useful for the step. For example, reagents are cycled by a series of liquid deposition and vacuum drying steps. For substrates comprising three-dimensional features such as wells, microwells, channels and the like, reagents are optionally passed through one or more regions of the device via the wells and/or channels.

Methods and systems described herein relate to polynucleotide synthesis devices for the synthesis of polynucleotides. The synthesis may be in parallel. For example, at least or about at least 2, 3, 4, 5, 6, 7, 8, 9, 10, 11, 12, 13, 14, 15, 16, 17, 18, 19, 20, 21, 22, 23, 24, 25, 30, 35, 40, 45, 50, 100, 150, 200, 250, 300, 350, 400, 450, 500, 550, 600, 650, 700, 750, 800, 850, 900, 1000, 10000, 50000, 75000, 100000 or more polynucleotides can be synthesized in parallel. The total number polynucleotides that may be synthesized in parallel may be from 2-100000, 3-50000, 4-10000, 5-1000, 6-900, 7-850, 8-800, 9-750, 10-700, 11-650, 12-600, 13-550, 14-500, 15-450, 16-400, 17-350, 18-300, 19-250, 20-200, 21-150, 22-100, 23-50, 24-45, 25-40, 30-35. Those of skill in the art appreciate that the total number of polynucleotides synthesized in parallel may fall within any range bound by any of these values, for example 25-100. The total number of polynucleotides synthesized in parallel may fall within any range defined by any of the values serving as endpoints of the range. Total molar mass of polynucleotides synthesized within the device or the molar mass of each of the polynucleotides may be at least or at least about 10, 20, 30, 40, 50, 100, 250, 500, 750, 1000, 2000, 3000, 4000, 5000, 6000, 7000, 8000, 9000, 10000, 25000, 50000, 75000, 100000 picomoles, or more. The length of each of the polynucleotides or average length of the polynucleotides within the device may be at least or about at least 10, 15, 20, 25, 30, 35, 40, 45, 50, 100, 150, 200, 300, 400, 500 nucleotides, or more. The length of each of the polynucleotides or average length of the polynucleotides within the device may be at most or about at most 500, 400, 300, 200, 150, 100, 50, 45, 35, 30, 25, 20, 19, 18, 17, 16, 15, 14, 13, 12, 11, 10 nucleotides, or less. The length of each of the polynucleotides or average length of the polynucleotides within the device may fall from 10-500, 9-400, 11-300, 12-200, 13-150, 14-100, 15-50, 16-45, 17-40, 18-35, 19-25. Those of skill in the art appreciate that the length of each of the polynucleotides or average length of the polynucleotides within the device may fall within any range bound by any of these values, for example 100-300. The length of each of the polynucleotides or average length of the polynucleotides within the device may fall within any range defined by any of the values serving as endpoints of the range.

Methods for polynucleotide synthesis on a surface provided herein allow for synthesis at a fast rate. As an example, at least 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 70, 80, 90, 100, 125, 150, 175, 200 nucleotides per hour, or more are synthesized. Nucleotides include adenine, guanine, thymine, cytosine, uridine building blocks, or analogs/modified versions thereof. In some instances, libraries of polynucleotides are synthesized in parallel on substrate. For example, a device comprising about or at least about 100; 1,000; 10,000; 30,000; 75,000; 100,000; 1,000,000; 2,000,000; 3,000,000; 4,000,000; or 5,000,000 resolved loci is able to support the synthesis of at least the same number of distinct polynucleotides, wherein polynucleotide encoding a distinct sequence is synthesized on a resolved locus. In some instances, a library of polynucleotides is synthesized on a device with low error rates described herein in less than about three months, two months, one month, three weeks, 15, 14, 13, 12, 11, 10, 9, 8, 7, 6, 5, 4, 3, 2 days, 24 hours or less. In some instances, larger nucleic acids assembled from a polynucleotide library synthesized with low error rate using the substrates and methods described herein are prepared in less than about three months, two months, one month, three weeks, 15, 14, 13, 12, 11, 10, 9, 8, 7, 6, 5, 4, 3, 2 days, 24 hours or less.

In some instances, methods described herein provide for generation of a library of nucleic acids comprising variant nucleic acids differing at a plurality of codon sites. In some instances, a nucleic acid may have 1 site, 2 sites, 3 sites, 4 sites, 5 sites, 6 sites, 7 sites, 8 sites, 9 sites, 10 sites, 11 sites, 12 sites, 13 sites, 14 sites, 15 sites, 16 sites, 17 sites 18 sites, 19 sites, 20 sites, 30 sites, 40 sites, 50 sites, or more of variant codon sites.

In some instances, the one or more sites of variant codon sites may be adjacent. In some instances, the one or more sites of variant codon sites may not be adjacent and separated by 1, 2, 3, 4, 5, 6, 7, 8, 9, 10, or more codons.

In some instances, a nucleic acid may comprise multiple sites of variant codon sites, wherein all the variant codon sites are adjacent to one another, forming a stretch of variant codon sites. In some instances, a nucleic acid may comprise multiple sites of variant codon sites, wherein none the variant codon sites are adjacent to one another. In some instances, a nucleic acid may comprise multiple sites of variant codon sites, wherein some the variant codon sites are adjacent to one another, forming a stretch of variant codon sites, and some of the variant codon sites are not adjacent to one another.

Figure 2:
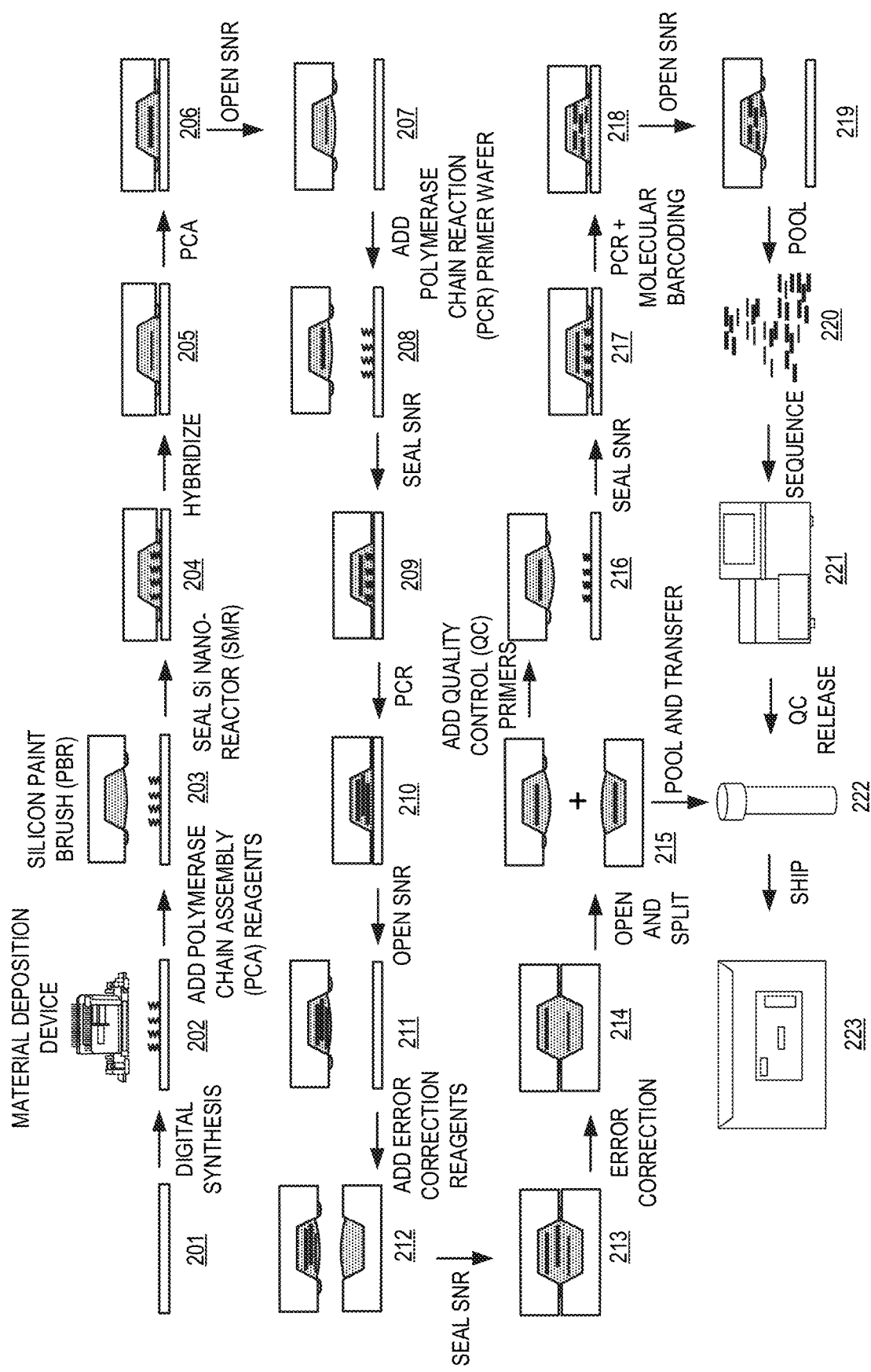
FIG. 2 presents a diagram of steps demonstrating an exemplary process workflow for gene synthesis as disclosed herein.

Referring to the Figures, FIG. 2 illustrates an exemplary process workflow for synthesis of nucleic acids (e.g., genes) from shorter nucleic acids. The workflow is divided generally into phases: (1) de novo synthesis of a single stranded nucleic acid library, (2) joining nucleic acids to form larger fragments, (3) error correction, (4) quality control, and (5) shipment. Prior to de novo synthesis, an intended nucleic acid sequence or group of nucleic acid sequences is preselected. For example, a group of genes is preselected for generation.

Once large nucleic acids for generation are selected, a predetermined library of nucleic acids is designed for de novo synthesis. Various suitable methods are known for generating high density polynucleotide arrays. In the workflow example, a device surface layer is provided. In the example, chemistry of the surface is altered in order to improve the polynucleotide synthesis process. Areas of low surface energy are generated to repel liquid while areas of high surface energy are generated to attract liquids. The surface itself may be in the form of a planar surface or contain variations in shape, such as protrusions or microwells which increase surface area. In the workflow example, high surface energy molecules selected serve a dual function of supporting DNA chemistry, as disclosed in International Patent Application Publication WO/2015/021080, which is herein incorporated by reference in its entirety.

In situ preparation of polynucleotide arrays is generated on a solid support and utilizes single nucleotide extension process to extend multiple oligomers in parallel. A deposition device, such as a material deposition device 201, is designed to release reagents in a step wise fashion such that multiple polynucleotides extend, in parallel, one residue at a time to generate oligomers with a predetermined nucleic acid sequence 202. In some instances, polynucleotides are cleaved from the surface at this stage. Cleavage includes gas cleavage, e.g., with ammonia or methylamine.

The generated polynucleotide libraries are placed in a reaction chamber. In this exemplary workflow, the reaction chamber (also referred to as "nanoreactor") is a silicon coated well, containing PCR reagents and lowered onto the polynucleotide library 203. Prior to or after the sealing 204 of the polynucleotides, a reagent is added to release the polynucleotides from the substrate. In the exemplary workflow, the polynucleotides are released subsequent to sealing of the nanoreactor 205. Once released, fragments of single stranded polynucleotides hybridize in order to span an entire long range sequence of DNA. Partial hybridization 205 is possible because each synthesized polynucleotide is designed to have a small portion overlapping with at least one other polynucleotide in the pool.

After hybridization, a PCA reaction is commenced. During the polymerase cycles, the polynucleotides anneal to complementary fragments and gaps are filled in by a polymerase. Each cycle increases the length of various fragments randomly depending on which polynucleotides find each other. Complementarity amongst the fragments allows for forming a complete large span of double stranded DNA 206.

After PCA is complete, the nanoreactor is separated from the device 207 and positioned for interaction with a device having primers for PCR 208. After sealing, the nanoreactor is subject to PCR 209 and the larger nucleic acids are amplified. After PCR 210, the nanochamber is opened 211, error correction reagents are added 212, the chamber is sealed 213 and an error correction reaction occurs to remove mismatched base pairs and/or strands with poor complementarity from the double stranded PCR amplification products 214. The nanoreactor is opened and separated 215. Error corrected product is next subject to additional processing steps, such as PCR and molecular bar coding, and then packaged 222 for shipment 223.

In some instances, quality control measures are taken. After error correction, quality control steps include for example interaction with a wafer having sequencing primers for amplification of the error corrected product 216, sealing the wafer to a chamber containing error corrected amplification product 217, and performing an additional round of amplification 218. The nanoreactor is opened 219 and the products are pooled 220 and sequenced 221. After an acceptable quality control determination is made, the packaged product 222 is approved for shipment 223.

In some instances, a nucleic acid generate by a workflow such as that in FIG. 2 is subject to mutagenesis using overlapping primers disclosed herein. In some instances, a library of primers are generated by in situ preparation on a solid support and utilize single nucleotide extension process to extend multiple oligomers in parallel. A deposition device, such as a material deposition device, is designed to release reagents in a step wise fashion such that multiple polynucleotides extend, in parallel, one residue at a time to generate oligomers with a predetermined nucleic acid sequence 202.

Computer Systems

Any of the systems described herein, may be operably linked to a computer and may be automated through a computer either locally or remotely. In various instances, the methods and systems of the disclosure may further comprise software programs on computer systems and use thereof. Accordingly, computerized control for the synchronization of the dispense/vacuum/refill functions such as orchestrating and synchronizing the material deposition device movement, dispense action and vacuum actuation are within the bounds of the disclosure. The computer systems may be programmed to interface between the user specified base sequence and the position of a material deposition device to deliver the correct reagents to specified regions of the substrate.

Figure 3:
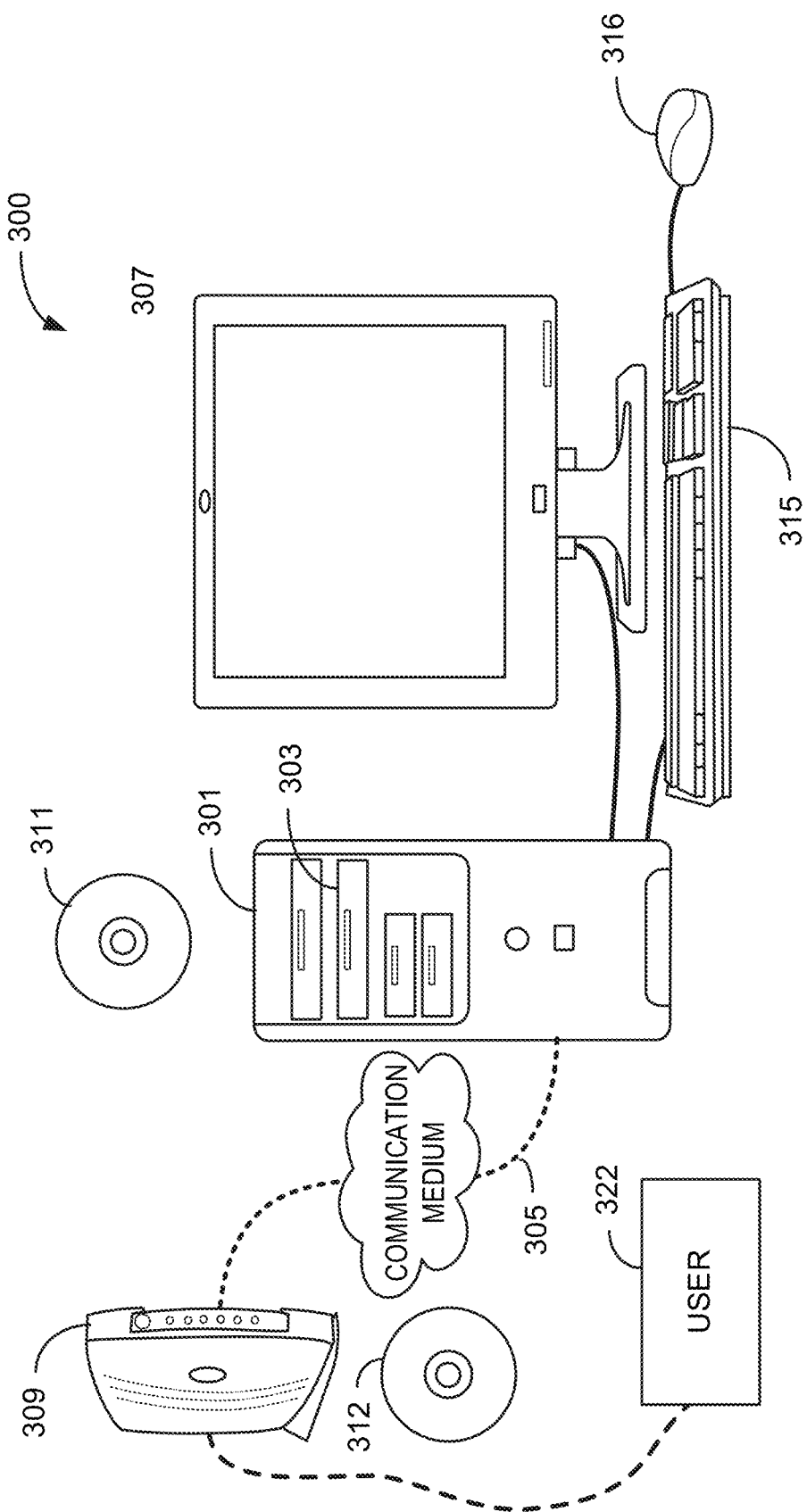
FIG. 3 illustrates an example of a computer system.

The computer system 300 illustrated in FIG. 3 may be understood as a logical apparatus that can read instructions from media 311 and/or a network port 305, which can optionally be connected to server 309 having fixed media 312. The system, such as shown in FIG. 3 can include a CPU 301, disk drives 303, optional input devices such as keyboard 315 and/or mouse 316 and optional monitor 307. Data communication can be achieved through the indicated communication medium to a server at a local or a remote location. The communication medium can include any means of transmitting and/or receiving data. For example, the communication medium can be a network connection, a wireless connection or an internet connection. Such a connection can provide for communication over the World Wide Web. It is envisioned that data relating to the present disclosure can be transmitted over such networks or connections for reception and/or review by a party 322 as illustrated in FIG. 3.

Figure 4:
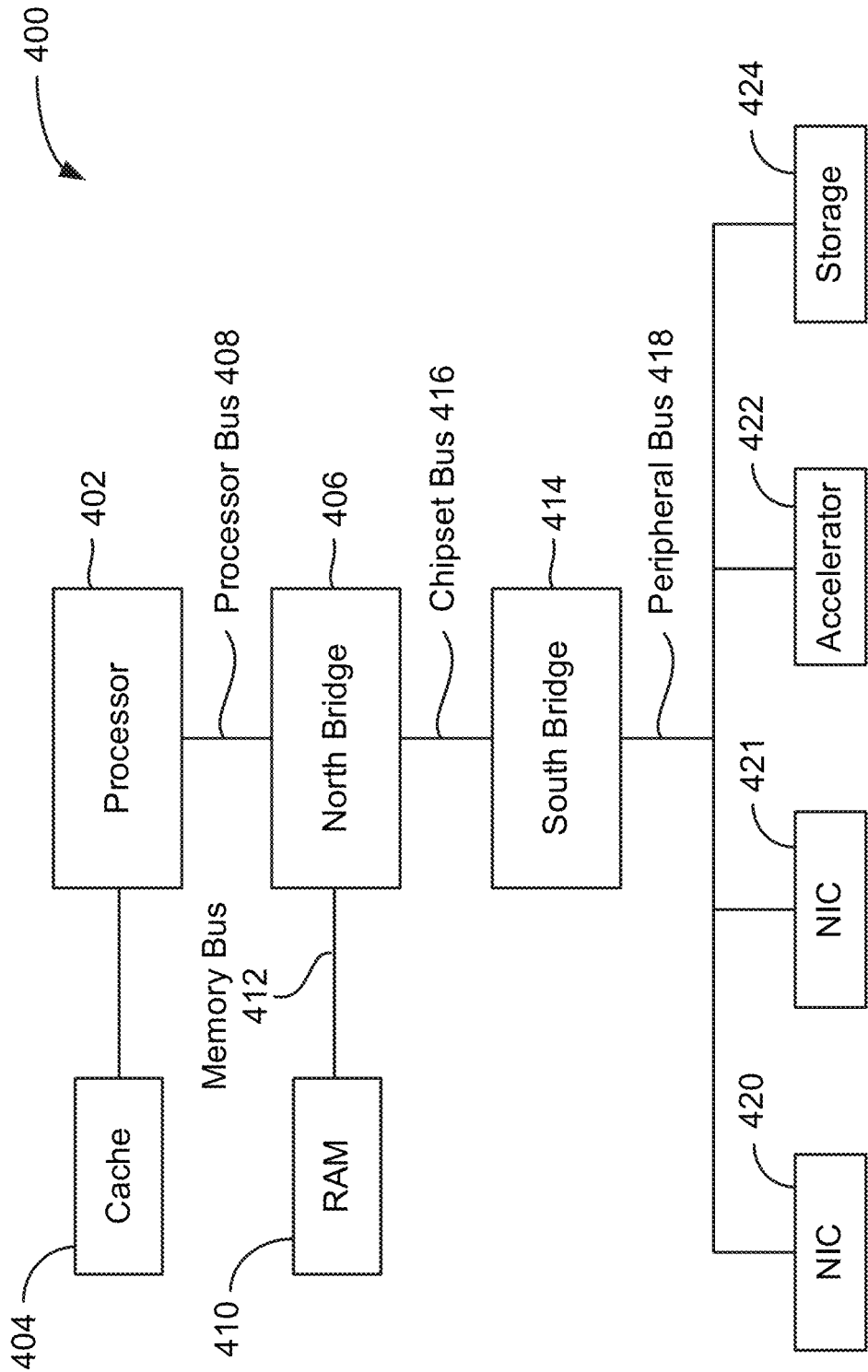
FIG. 4 is a block diagram illustrating an architecture of a computer system.

FIG. 4 is a block diagram illustrating a first example architecture of a computer system 400 that can be used in connection with example instances of the present disclosure. As depicted in FIG. 4, the example computer system can include a processor 402 for processing instructions. Non-limiting examples of processors include: Intel Xeon™ processor, AMD Opteron™ processor, Samsung 32-bit RISC ARM 1176JZ(F)-S v1.0™ processor, ARM Cortex-A8 Samsung S5PC100™ processor, ARM Cortex-A8 Apple A4™ processor, Marvell PXA 930™ processor, or a functionally-equivalent processor. Multiple threads of execution can be used for parallel processing. In some instances, multiple processors or processors with multiple cores can also be used, whether in a single computer system, in a cluster, or distributed across systems over a network comprising a plurality of computers, cell phones, and/or personal data assistant devices.

As illustrated in FIG. 4, a high speed cache 404 can be connected to, or incorporated in, the processor 402 to provide a high speed memory for instructions or data that have been recently, or are frequently, used by processor 402. The processor 402 is connected to a north bridge 406 by a processor bus 408. The north bridge 406 is connected to random access memory (RAM) 410 by a memory bus 412 and manages access to the RAM 410 by the processor 402. The north bridge 406 is also connected to a south bridge 414 by a chipset bus 416. The south bridge 414 is, in turn, connected to a peripheral bus 418. The peripheral bus can be, for example, PCI, PCI-X, PCI Express, or other peripheral bus. The north bridge and south bridge are often referred to as a processor chipset and manage data transfer between the processor, RAM, and peripheral components on the peripheral bus 418. In some alternative architectures, the functionality of the north bridge can be incorporated into the processor instead of using a separate north bridge chip. In some instances, system 400 can include an accelerator card 422 attached to the peripheral bus 418. The accelerator can include field programmable gate arrays (FPGAs) or other hardware for accelerating certain processing. For example, an accelerator can be used for adaptive data restructuring or to evaluate algebraic expressions used in extended set processing.

Software and data are stored in external storage 424 and can be loaded into RAM 410 and/or cache 404 for use by the processor. The system 400 includes an operating system for managing system resources; non-limiting examples of operating systems include: Linux, Windows™, MACOS™, BlackBerry OS™, iOS™, and other functionally-equivalent operating systems, as well as application software running on top of the operating system for managing data storage and optimization in accordance with example instances of the present disclosure. In this example, system 400 also includes network interface cards (NICs) 420 and 421 connected to the peripheral bus for providing network interfaces to external storage, such as Network Attached Storage (NAS) and other computer systems that can be used for distributed parallel processing.

Figure 5:
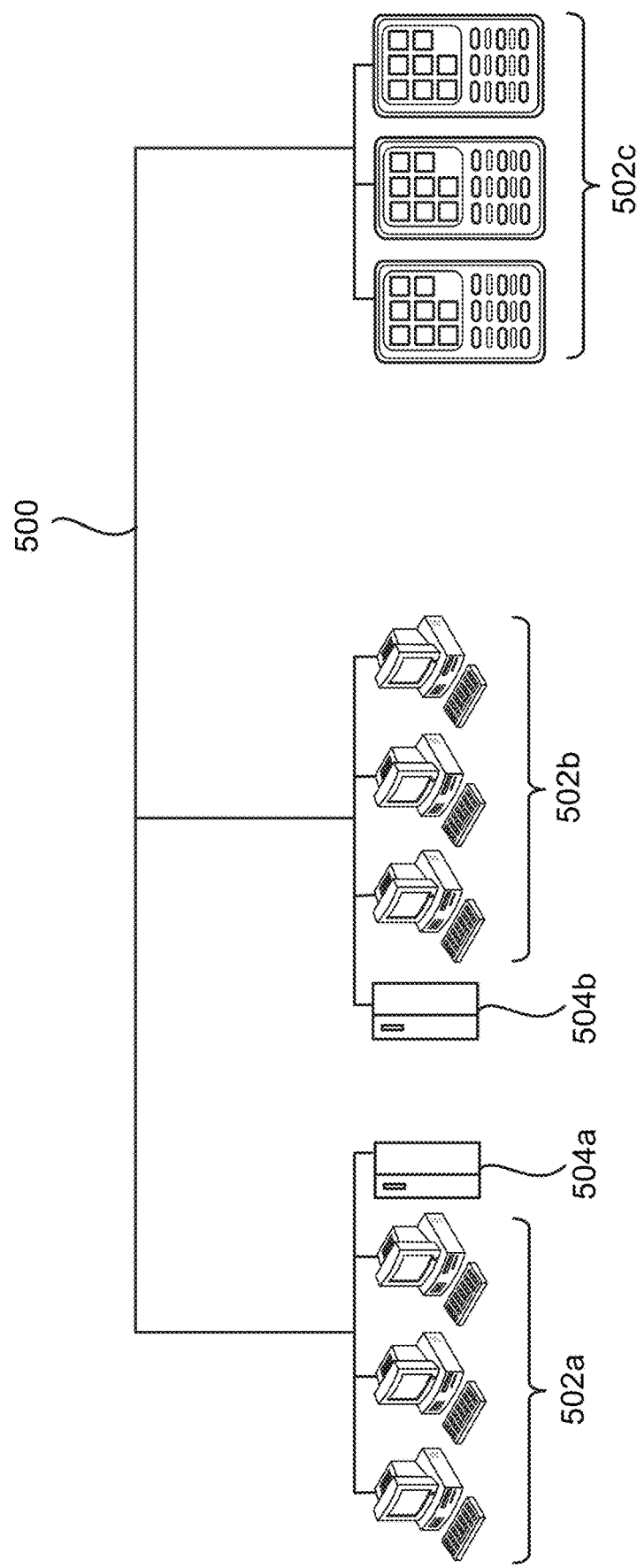
FIG. 5 is a diagram demonstrating a network configured to incorporate a plurality of computer systems, a plurality of cell phones and personal data assistants, and Network Attached Storage (NAS).

FIG. 5 is a diagram showing a network 500 with a plurality of computer systems 502a, and 502b, a plurality of cell phones and personal data assistants 502c, and Network Attached Storage (NAS) 504a, and 504b. In example instances, systems 502a, 502b, and 502c can manage data storage and optimize data access for data stored in Network Attached Storage (NAS) 504a and 504b. A mathematical model can be used for the data and be evaluated using distributed parallel processing across computer systems 502a, and 502b, and cell phone and personal data assistant systems 502c. Computer systems 502a, and 502b, and cell phone and personal data assistant systems 502c can also provide parallel processing for adaptive data restructuring of the data stored in Network Attached Storage (NAS) 504a and 504b. FIG. 5 illustrates an example only, and a wide variety of other computer architectures and systems can be used in conjunction with the various instances of the present disclosure. For example, a blade server can be used to provide parallel processing. Processor blades can be connected through a back plane to provide parallel processing. Storage can also be connected to the back plane or as Network Attached Storage (NAS) through a separate network interface. In some example instances, processors can maintain separate memory spaces and transmit data through network interfaces, back plane or other connectors for parallel processing by other processors. In other instances, some or all of the processors can use a shared virtual address memory space.

Figure 6:
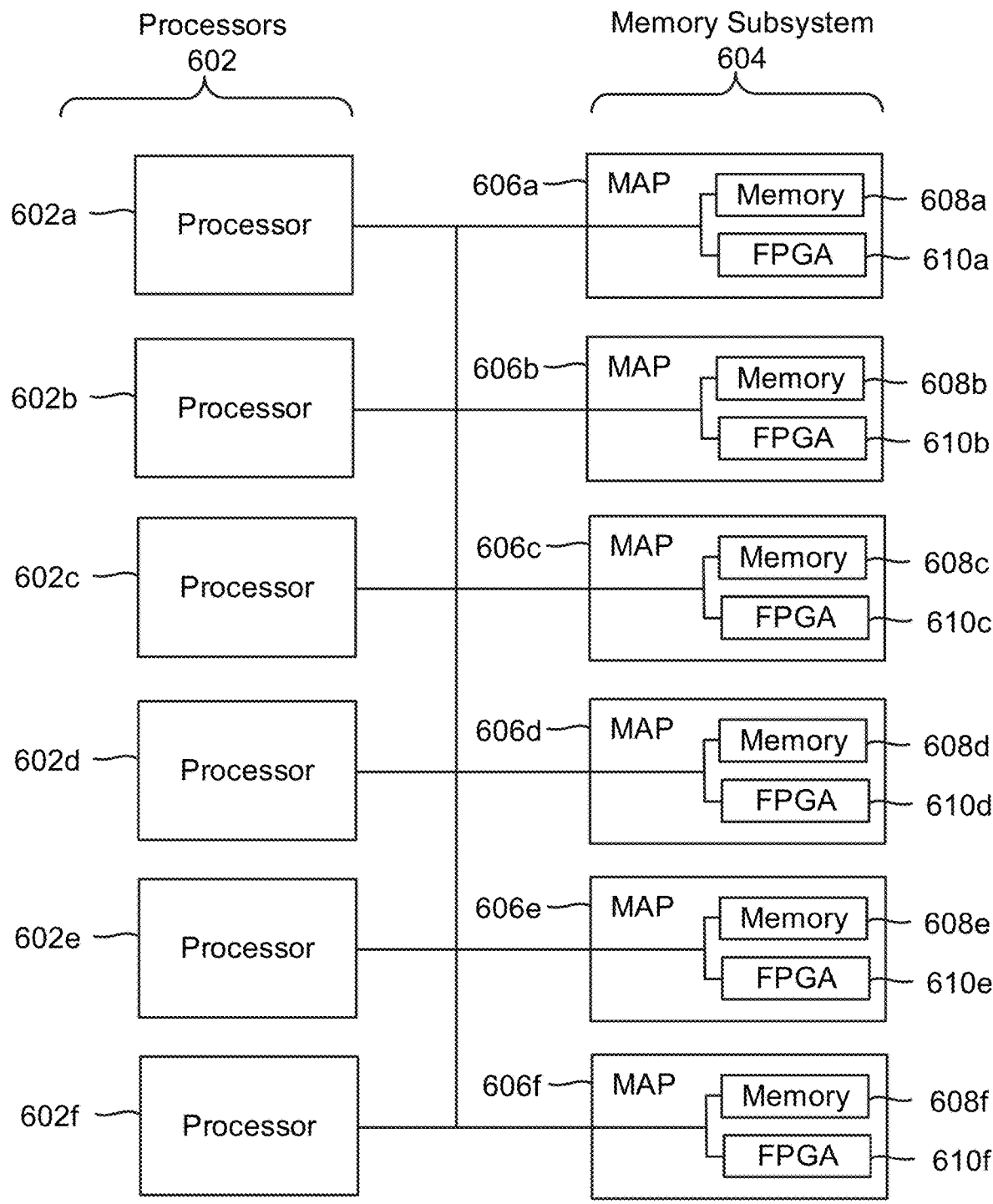
FIG. 6 is a block diagram of a multiprocessor computer system using a shared virtual address memory space.

FIG. 6 is a block diagram of a multiprocessor computer system using a shared virtual address memory space in accordance with an example instance. The system includes a plurality of processors 602a-f that can access a shared memory subsystem 604. The system incorporates a plurality of programmable hardware memory algorithm processors (MAPs) 606a-f in the memory subsystem 604. Each MAP 606a-f can comprise a memory 608a-f and one or more field programmable gate arrays (FPGAs) 610a-f. The MAP provides a configurable functional unit and particular algorithms or portions of algorithms can be provided to the FPGAs 610a-f for processing in close coordination with a respective processor. For example, the MAPs can be used to evaluate algebraic expressions regarding the data model and to perform adaptive data restructuring in example instances. In this example, each MAP is globally accessible by all of the processors for these purposes. In one configuration, each MAP can use Direct Memory Access (DMA) to access an associated memory 608a-f, allowing it to execute tasks independently of, and asynchronously from the respective microprocessor 602a-f. In this configuration, a MAP can feed results directly to another MAP for pipelining and parallel execution of algorithms.

The above computer architectures and systems are examples only, and a wide variety of other computer, cell phone, and personal data assistant architectures and systems can be used in connection with example instances, including systems using any combination of general processors, co-processors, FPGAs and other programmable logic devices, system on chips (SOCs), application specific integrated circuits (ASICs), and other processing and logic elements. In some instances, all or part of the computer system can be implemented in software or hardware. Any variety of data storage media can be used in connection with example instances, including random access memory, hard drives, flash memory, tape drives, disk arrays, Network Attached Storage (NAS) and other local or distributed data storage devices and systems.

In example instances, the computer system can be implemented using software modules executing on any of the above or other computer architectures and systems. In other instances, the functions of the system can be implemented partially or completely in firmware, programmable logic devices such as field programmable gate arrays (FPGAs) as referenced in FIG. 4, system on chips (SOCs), application specific integrated circuits (ASICs), or other processing and logic elements. For example, the Set Processor and Optimizer can be implemented with hardware acceleration through the use of a hardware accelerator card, such as accelerator card 422 illustrated in FIG. 4.

The following examples are set forth to illustrate more clearly the principle and practice of embodiments disclosed herein to those skilled in the art and are not to be construed as limiting the scope of any claimed embodiments. Unless otherwise stated, all parts and percentages are on a weight basis.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art.

Example 1: Functionalization of a Device Surface

A device was functionalized to support the attachment and synthesis of a library of polynucleotides. The device surface was first wet cleaned using a piranha solution comprising 90% $H_2SO_4$ and 10% $H_2O_2$ for 20 minutes. The device was rinsed in several beakers with DI water, held under a DI water gooseneck faucet for 5 min, and dried with $N_2$. The device was subsequently soaked in $NH_4OH$ (1:100; 3 mL:300 mL) for 5 min, rinsed with DI water using a handgun, soaked in three successive beakers with DI water for 1 min each, and then rinsed again with DI water using the handgun. The device was then plasma cleaned by exposing the device surface to $O_2$. A SAMCO PC-300 instrument was used to plasma etch $O_2$ at 250 watts for 1 min in downstream mode.

The cleaned device surface was actively functionalized with a solution comprising N-(3-triethoxysilylpropyl)-4-hydroxybutyramide using a YES-1224P vapor deposition oven system with the following parameters: 0.5 to 1 ton, 60 min, 70° C., 135° C. vaporizer. The device surface was resist coated using a Brewer Science 200× spin coater. SPR™ 3612 photoresist was spin coated on the device at 2500 rpm for 40 sec. The device was pre-baked for 30 min at 90° C. on a Brewer hot plate. The device was subjected to photolithography using a Karl Suss MA6 mask aligner instrument. The device was exposed for 2.2 sec and developed for 1 min in MSF 26A. Remaining developer was rinsed with the handgun and the device soaked in water for 5 min. The device was baked for 30 min at 100° C. in the oven, followed by visual inspection for lithography defects using a Nikon L200. A descum process was used to remove residual resist using the SAMCO PC-300 instrument to $O_2$ plasma etch at 250 watts for 1 min.

The device surface was passively functionalized with a 100 μL solution of perfluorooctyltrichlorosilane mixed with 10 μL light mineral oil. The device was placed in a chamber, pumped for 10 min, and then the valve was closed to the pump and left to stand for 10 min. The chamber was vented to air. The device was resist stripped by performing two soaks for 5 min in 500 mL NMP at 70° C. with ultrasonication at maximum power (9 on Crest system). The device was then soaked for 5 min in 500 mL isopropanol at room temperature with ultrasonication at maximum power. The device was dipped in 300 mL of 200 proof ethanol and blown dry with $N_2$. The functionalized surface was activated to serve as a support for polynucleotide synthesis.

Example 2: Synthesis of a 50-Mer Sequence on an Oligonucleotide Synthesis Device A two dimensional oligonucleotide synthesis device was assembled into a flowcell, which was connected to a flowcell (Applied Biosystems (ABI394 DNA Synthesizer"). The two-dimensional oligonucleotide synthesis device was uniformly functionalized with N-(3-TRIETHOXYSILYLPROPYL)-4-HYDROXYBUTYRAMIDE (Gelest) was used to synthesize an exemplary polynucleotide of 50 bp ("50-mer polynucleotide") using polynucleotide synthesis methods described herein.

The sequence of the 50-mer was as described.

(SEQ ID NO: 2669)
5'AGACAATCAACCATTTGGGGTGGACAGCCTTGACCTCTAGACTTCGG

CAT##TTTTTTTTTT3', where #denotes Thymidine-succinyl hexamide CED phosphoramidite (CLP-2244 from ChemGenes), which is a cleavable linker enabling the release of oligos from the surface during deprotection.

TABLE 2

| Synthesis protocols | | |
|---|---|---|
| General DNA | Table 2 | |
| Synthesis Process Name | Process Step | Time (sec) |
| WASH (Acetonitrile Wash Flow) | Acetonitrile System Flush | 4 |
| | Acetonitrile to Flowcell | 23 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 6 |
| | Activator + Phosphoramidite to Flowcell | 6 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 5 |
| | Activator + Phosphoramidite to Flowcell | 18 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |

TABLE 2-continued

Synthesis protocols

| General DNA Synthesis Process Name | Process Step | Time (sec) |
|---|---|---|
| CAPPING (CapA + B, 1:1, Flow) | CapA + B to Flowcell | 15 |
| WASH (Acetonitrile Wash Flow) | Acetonitrile System Flush | 4 |
|  | Acetonitrile to Flowcell | 15 |
|  | Acetonitrile System Flush | 4 |
| OXIDATION (Oxidizer Flow) | Oxidizer to Flowcell | 18 |
| WASH (Acetonitrile Wash Flow) | Acetonitrile System Flush | 4 |
|  | N2 System Flush | 4 |
|  | Acetonitrile System Flush | 4 |
|  | Acetonitrile to Flowcell | 15 |
|  | Acetonitrile System Flush | 4 |
|  | Acetonitrile to Flowcell | 15 |
|  | N2 System Flush | 4 |
|  | Acetonitrile System Flush | 4 |
|  | Acetonitrile to Flowcell | 23 |
|  | N2 System Flush | 4 |
|  | Acetonitrile System Flush | 4 |
| DEBLOCKING (Deblock Flow) | Deblock to Flowcell | 36 |
| WASH (Acetonitrile Wash Flow) | Acetonitrile System Flush | 4 |
|  | N2 System Flush | 4 |
|  | Acetonitrile System Flush | 4 |
|  | Acetonitrile to Flowcell | 18 |
|  | N2 System Flush | 4.13 |
|  | Acetonitrile System Flush | 4.13 |
|  | Acetonitrile to Flowcell | 15 |

The phosphoramidite/activator combination was delivered similar to the delivery of bulk reagents through the flowcell. No drying steps were performed as the environment stays "wet" with reagent the entire time.

The flow restrictor was removed from the ABI 394 synthesizer to enable faster flow. Without flow restrictor, flow rates for amidites (0.1M in ACN), Activator, (0.25M Benzoylthiotetrazole ("BTT"; 30-3070-xx from GlenResearch) in ACN), and Ox (0.02M 12 in 20% pyridine, 10% water, and 70% THF) were roughly ~100 uL/sec, for acetonitrile ("ACN") and capping reagents (1:1 mix of CapA and CapB, wherein CapA is acetic anhydride in THF/Pyridine and CapB is 16% 1-methylimidizole in THF), roughly ~200 uL/sec, and for Deblock (3% dichloroacetic acid in toluene), roughly ~300 uL/sec (compared to ~50 uL/sec for all reagents with flow restrictor). The time to completely push out Oxidizer was observed, the timing for chemical flow times was adjusted accordingly and an extra ACN wash was introduced between different chemicals. After polynucleotide synthesis, the chip was deprotected in gaseous ammonia overnight at 75 psi. Five drops of water were applied to the surface to recover polynucleotides. The recovered polynucleotides were then analyzed on a BioAnalyzer small RNA chip.

Example 3: Synthesis of a 100-Mer Sequence on an Oligonucleotide Synthesis Device The same process as described in Example 2 for the synthesis of the 50-mer sequence was used for the synthesis of a 100-mer polynucleotide ("100-mer polynucleotide"; 5'CGGGATCCTTATCGTCATCGTCGTACA-GATCCCGACCCATTTGCTGTCCACCAGTCA TGCTAGCCATACCATGATGATGATGATGAT-GAGAACCCCGCAT ##TTTTTTTTTT3' (SEQ ID NO: 2670), where #denotes Thymidine-succinyl hexamide CED phosphoramidite (CLP-2244 from ChemGenes) on two different silicon chips, the first one uniformly functionalized with N-(3-TRIETHOXYSILYLPROPYL)-4-HYDROXY-BUTYRAMIDE and the second one functionalized with 5/95 mix of 11-acetoxyundecyltriethoxysilane and n-decyltriethoxysilane, and the polynucleotides extracted from the surface were analyzed on a BioAnalyzer instrument.

All ten samples from the two chips were further PCR amplified using a forward (5'ATGCGGGGTTCTCAT-CATC3' (SEQ ID NO: 2671)) and a reverse (5'CGG-GATCCTTATCGTCATCG3' (SEQ ID NO: 2672)) primer in a 50 uL PCR mix (25 uL NEB Q5 mastermix, 2.5 uL 10 uM Forward primer, 2.5 uL 10 uM Reverse primer, luL polynucleotide extracted from the surface, and water up to 50 uL) using the following thermalcycling program:

98° C., 30 sec

98° C., 10 sec; 63° C., 10 sec; 72° C., 10 sec; repeat 12 cycles

72° C., 2 min

The PCR products were also run on a BioAnalyzer, demonstrating sharp peaks at the 100-mer position. Next, the PCR amplified samples were cloned, and Sanger sequenced. Table 3 summarizes the results from the Sanger sequencing for samples taken from spots 1-5 from chip 1 and for samples taken from spots 6-10 from chip 2.

TABLE 3

Sequencing results

| Spot | Error rate | Cycle efficiency |
|---|---|---|
| 1 | 1/763 bp | 99.87% |
| 2 | 1/824 bp | 99.88% |
| 3 | 1/780 bp | 99.87% |
| 4 | 1/429 bp | 99.77% |
| 5 | 1/1525 bp | 99.93% |
| 6 | 1/1615 bp | 99.94% |
| 7 | 1/531 bp | 99.81% |
| 8 | 1/1769 bp | 99.94% |
| 9 | 1/854 bp | 99.88% |
| 10 | 1/1451 bp | 99.93% |

Thus, the high quality and uniformity of the synthesized polynucleotides were repeated on two chips with different surface chemistries. Overall, 89% of the 100-mers that were sequenced were perfect sequences with no errors, corresponding to 233 out of 262.

Table 4 summarizes error characteristics for the sequences obtained from the polynucleotides samples from spots 1-10.

TABLE 4

Error characteristics

| Sample ID/Spot no. | OSA_0046/1 | OSA_0047/2 | OSA_0048/3 | OSA_0049/4 | OSA_0050/5 | OSA_0051/6 |
|---|---|---|---|---|---|---|
| Total Sequences | 32 | 32 | 32 | 32 | 32 | 32 |
| Sequencing Quality | 25 of 28 | 27 of 27 | 26 of 30 | 21 of 23 | 25 of 26 | 29 of 30 |
| Oligo Quality | 23 of 25 | 25 of 27 | 22 of 26 | 18 of 21 | 24 of 25 | 25 of 29 |
| ROI Match Count | 2500 | 2698 | 2561 | 2122 | 2499 | 2666 |
| ROI Mutation | 2 | 2 | 1 | 3 | 1 | 0 |
| ROI Multi Base Deletion | 0 | 0 | 0 | 0 | 0 | 0 |
| ROI Small Insertion | 1 | 0 | 0 | 0 | 0 | 0 |
| ROI Single Base Deletion | 0 | 0 | 0 | 0 | 0 | 0 |
| Large Deletion Count | 0 | 0 | 1 | 0 | 0 | 1 |
| Mutation: G > A | 2 | 2 | 1 | 2 | 1 | 0 |
| Mutation: T > C | 0 | 0 | 0 | 1 | 0 | 0 |
| ROI Error Count | 3 | 2 | 2 | 3 | 1 | 1 |
| ROI Error Rate | Err: ~1 in 834 | Err: ~1 in 1350 | Err: ~1 in 1282 | Err: ~1 in 708 | Err: ~1 in 2500 | Err: ~1 in 2667 |
| ROI Minus Primer Error Rate | MP Err: ~1 in 763 | MP Err: ~1 in 824 | MP Err: ~1 in 780 | MP Err: ~1 in 429 | MP Err: ~1 in 1525 | MP Err: ~1 in 1615 |

| Sample ID/Spot no. | OSA_0052/7 | OSA_0053/8 | OSA_0054/9 | OSA_0055/10 |
|---|---|---|---|---|
| Total Sequences | 32 | 32 | 32 | 32 |
| Sequencing Quality | 27 of 31 | 29 of 31 | 28 of 29 | 25 of 28 |
| Oligo Quality | 22 of 27 | 28 of 29 | 26 of 28 | 20 of 25 |
| ROI Match Count | 2625 | 2899 | 2798 | 2348 |
| ROI Mutation | 2 | 1 | 2 | 1 |
| ROI Multi Base Deletion | 0 | 0 | 0 | 0 |
| ROI Small Insertion | 0 | 0 | 0 | 0 |
| ROI Single Base Deletion | 0 | 0 | 0 | 0 |
| Large Deletion Count | 1 | 0 | 0 | 0 |
| Mutation: G > A | 2 | 1 | 2 | 1 |
| Mutation: T > C | 0 | 0 | 0 | 0 |
| ROI Error Count | 3 | 1 | 2 | 1 |
| ROI Error Rate | Err: ~1 in 876 | Err: ~1 in 2900 | Err: ~1 in 1400 | Err: ~1 in 2349 |
| ROI Minus Primer Error Rate | MP Err: ~1 in 531 | MP Err: ~1 in 1769 | MP Err: ~1 in 854 | MP Err: ~1 in 1451 |

Example 4: Panning and Screening for Identification of Antibodies for SARS-CoV-2 and ACE2

This example describes identification of antibodies for SARS-CoV-2 and ACE2.

Figure 7:
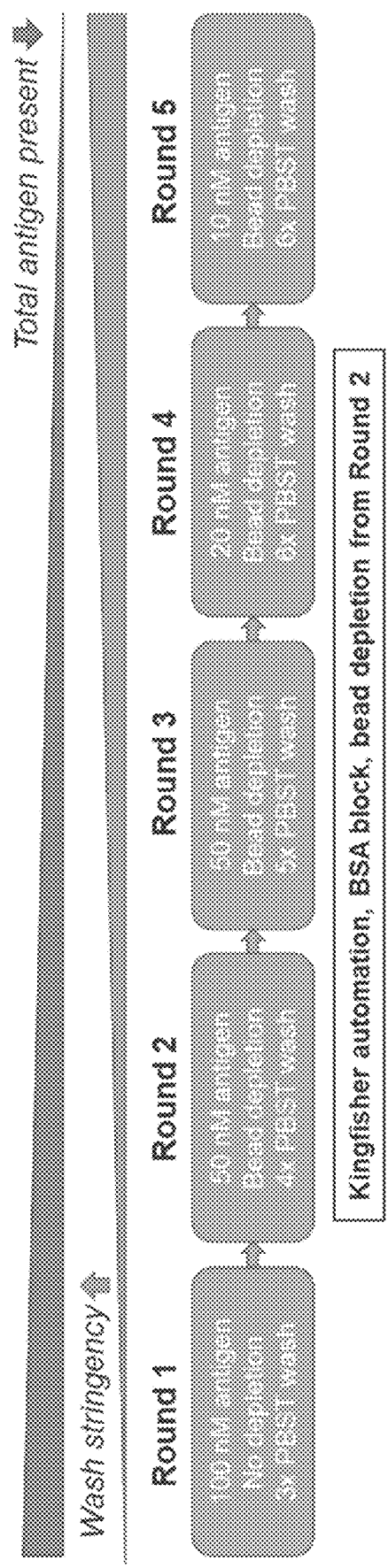
FIG. 7 is a schema of a panning workflow.

Phage displayed scFv, VHH, and Fab libraries were panned for binding to biotinylated SARS-CoV-2 S1 and human ACE2. FIG. 7 shows a schema of the panning strategy. Biotinylated antigen was bound to streptavidin coated magnetic beads at a density of 100 pmol antigen per mg of beads (Thermo Fisher #11206D). Phage libraries were blocked with 5% BSA in PBS. Following magnetic bead depletion for 1 hour at room temperature (RT), the beads were removed, and phage supernatant was transferred to 1 mg of antigen-bound beads in 1 ml PBS and incubated at RT with rotation for 1 hour. Non-binding clones were washed away by addition of 1 ml PBST, increasing the number of washes with each panning round. Trypsin was used to elute the phage bound to the antigen-bead complex. Phage were amplified in TG1 *E. coli* for the next round of selection. This selection strategy was repeated for four rounds, with successively lower amounts of antigen per round. Following all four selection rounds, 400 clones from each of round 2, 3, and 4 were selected for phage expression and phage ELISA screening. Data from the panning is seen in Table 5.

TABLE 5

Panning Data

| Antibody | Titer | Round 1 | Round 2 | Round 3 | Round 4 | Round 5 |
|---|---|---|---|---|---|---|
| 1 | Input titer | $1.5 \times 10^{12}$ | $1.2 \times 10^{13}$ | $4.4 \times 10^{13}$ | $1.8 \times 10^{13}$ | — |
|   | Output titer | $1.2 \times 10^{6}$ | $1.5 \times 10^{6}$ | $2.0 \times 10^{6}$ | $1.4 \times 10^{8}$ | — |
| 2 | Input titer | $1.4 \times 10^{12}$ | $2.6 \times 10^{13}$ | $3.0 \times 10^{13}$ | $1.0 \times 10^{13}$ | — |
|   | Output titer | $9.5 \times 10^{5}$ | $1.2 \times 10^{6}$ | $2.2 \times 10^{6}$ | $1.2 \times 10^{8}$ | — |

TABLE 5-continued

Panning Data

| Antibody | Titer | Round 1 | Round 2 | Round 3 | Round 4 | Round 5 |
|---|---|---|---|---|---|---|
| 3 | Input titer | $1.7 \times 10^{12}$ | $2.0 \times 10^{13}$ | $2.8 \times 10^{13}$ | $3.2 \times 10^{13}$ | — |
|   | Output titer | $1.5 \times 10^{5}$ | $1.7 \times 10^{6}$ | $1.5 \times 10^{6}$ | $1.1 \times 10^{8}$ | — |
| 4 | Input titer | $1.2 \times 10^{12}$ | $1.6 \times 10^{13}$ | $3.6 \times 10^{13}$ | $1.5 \times 10^{13}$ | — |
|   | Output titer | $1.3 \times 10^{5}$ | $2.2 \times 10^{7}$ | $2.6 \times 10^{7}$ | $2.5 \times 10^{8}$ | — |

Figure 8A:
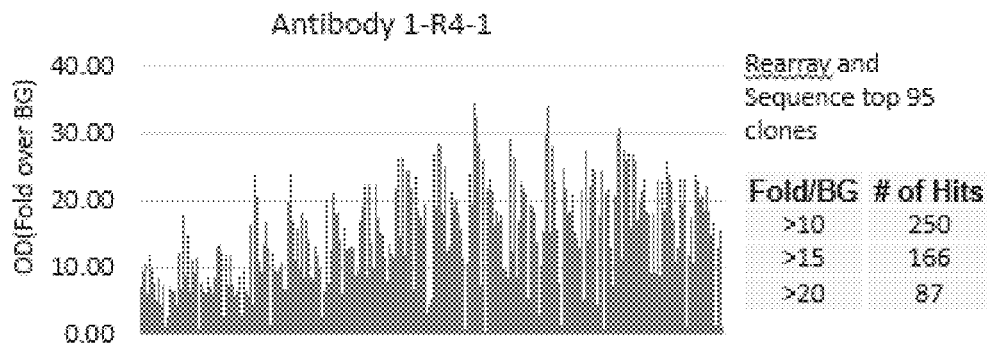
FIGS. 8A-8B are graphs of panning data from round 4 for antibody 1.
Figure 8B:
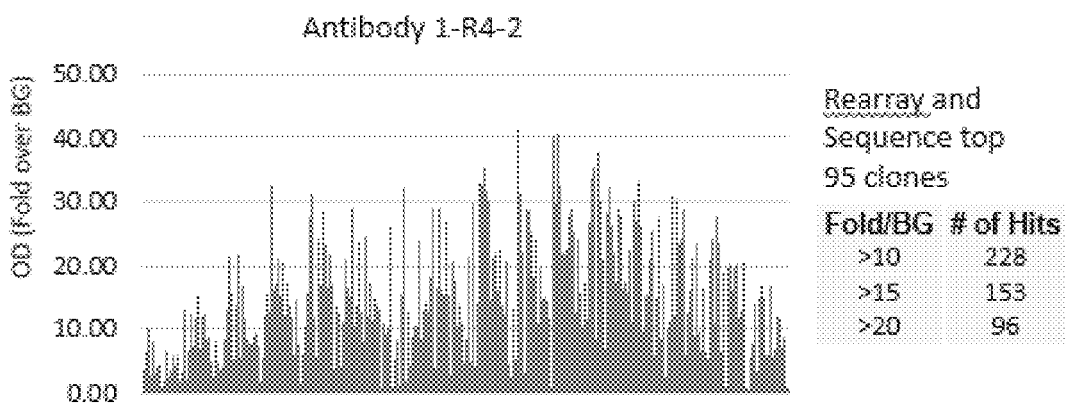
Figure 8C:
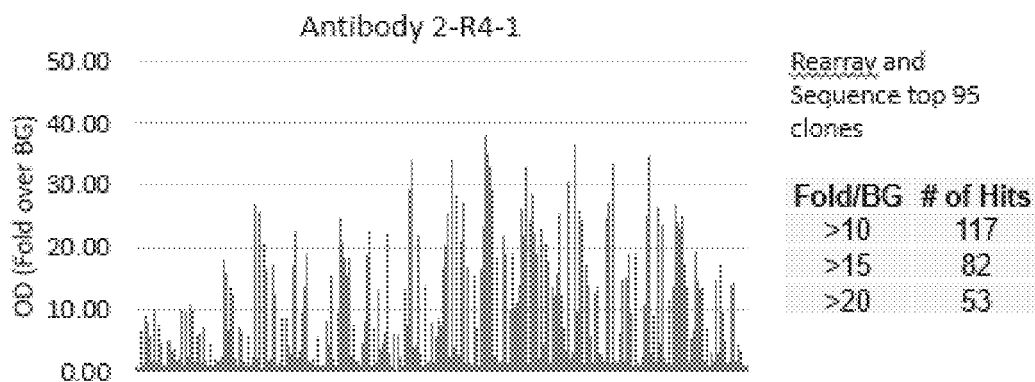
FIGS. 8C-8D are graphs of panning data from round 4 for antibody 2.
Figure 8D:
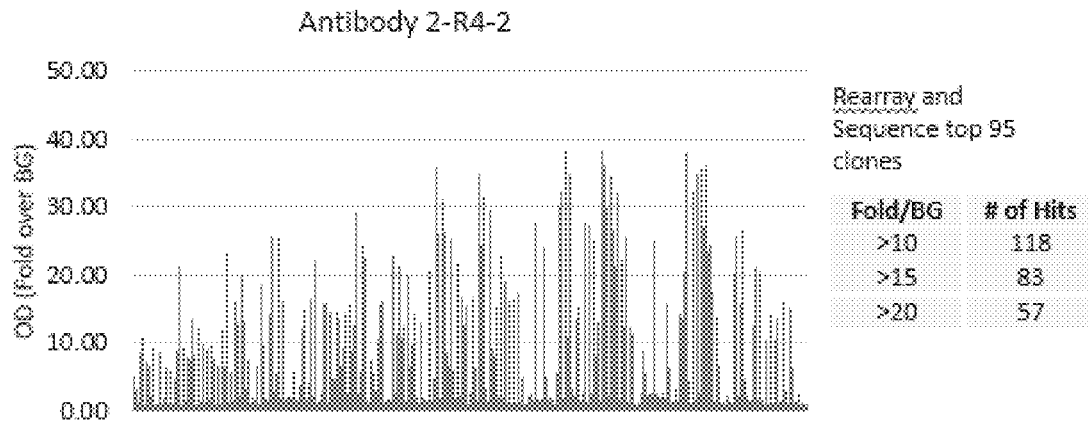
Figure 9A:
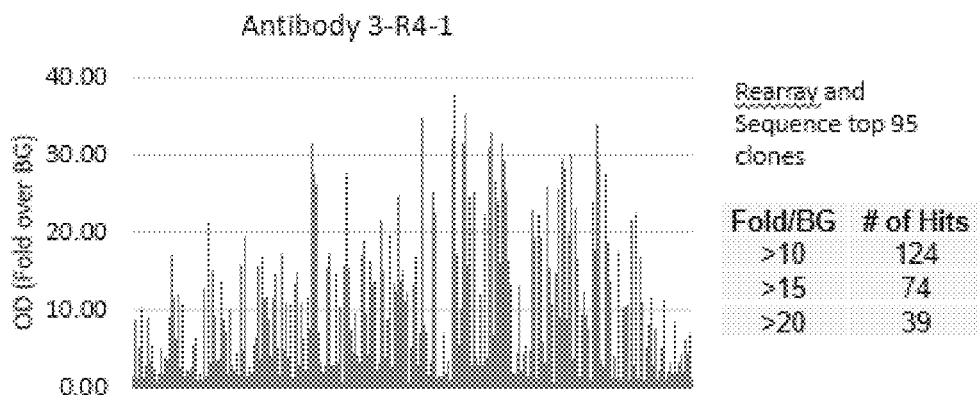
FIGS. 9A-9B are graphs of panning data from round 4 for antibody 3.
Figure 9B:
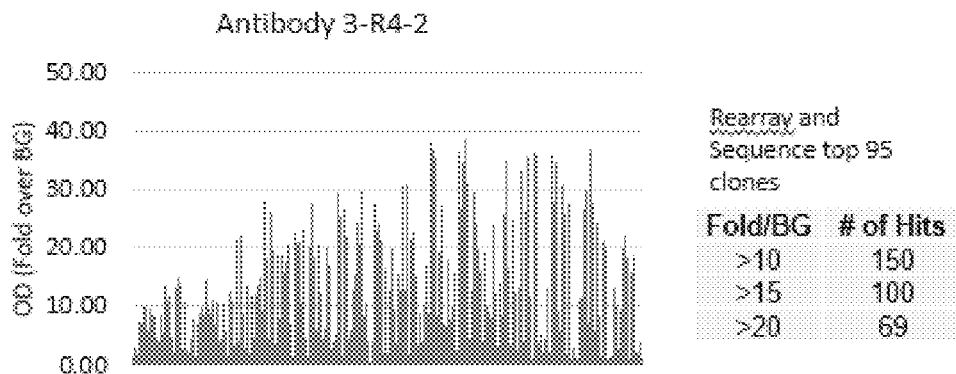
Figure 9C:
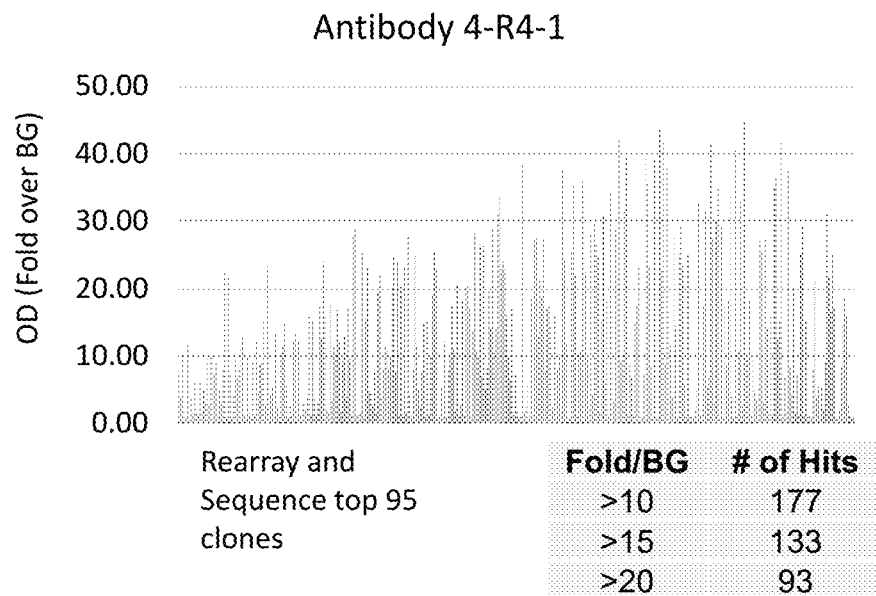
FIGS. 9C-9D are graphs of panning data from round 4 for antibody 4.
Figure 9D:
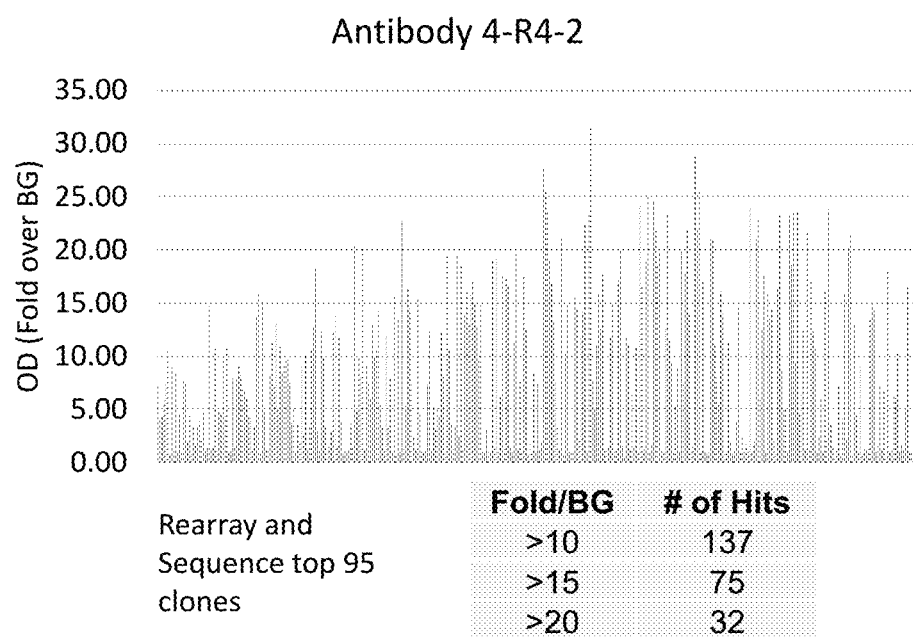

To test for binding to SARS-CoV-2 S1 and ACE2, phage were expressed from each picked colony by KO7 superinfection in 384 well microtiter plates. Phage containing supernatant was blocked by 1:1 addition of 4% non-fat milk (NFM). Assay plates were prepared by passive immobilization of 0.4 μg antigen in 384-well Maxisorp plates (Thermo Fisher #464718) and then blocked with 4% NFM. Following 3× wash in PBST, blocked phage supernatant was incubated for 1 hour at RT. After 3× wash in PBST, 0.3 μg/ml anti-M13-HRP (Sino Biological #11973-MM05T-H) was aliquoted for 1 hour incubation at room temperature. Binding of phage-displayed antibody was determined by absorbance at 450 nm with 3,3',5,5'-tetramethylbenzidine (Thermo Fisher #34029). Phage that bound to antigen with 3× over background of human Fc protein were identified as potential binders for sequencing analysis. DNA was amplified by rolling circle amplification from glycerol stocks of each clone and submitted for Sanger sequencing (Geneviz) to capture the VH and VL domains. FIGS. 8A-8D shows phage ELISA data from round 4 of SARS-CoV-2 S1 (subunit 1) protein panning for antibody 1 (FIGS. 8A-8B) and antibody 2 (FIGS. 8C-8D). FIGS. 9A-9D shows phage ELISA data from round 4 of ACE2 protein panning for antibody 3 (FIGS. 9A-9B) and antibody 4 (FIGS. 9C-9D).

SARS-CoV-2 variants were tested for specificity using a phage ELISA as described above. The antigens used included Acro COVID S1 (S1N-C82E8), COVID S1 RBD Fc fusion (Antigen 1), and COVID S1 RBM Fc fusion (Antigen 2). Data from the phage ELISA is seen in Table 6A. Table 6A shows screening ELISA mean, fold over background (column A), specificity ELISA, fold over background (column B), and specificity ELISA, percent binding relative to binding to Acro S1 (column C). As seen in Table 6A, nearly all receptor binding domain (RBD) specific clones show good binding to full length subunit 1 (S1) and produced S1 RBD Fc. None of the S1 RBD variants were found to bind to S1 RBM Fc.

TABLE 6A

SARS-CoV-2 Phage ELISA

| | Column A | Column B | | | Column C | | |
|---|---|---|---|---|---|---|---|
| Variant | ELISA (Avg) | Acro S1 | S1-RBD-Fc | S1-Fc | S1-RBM-Fc | S1-RBD-Fc | S1-Fc | S1-RBM-Fc |
| 1-21 | 47.6 | 19.5 | 14.8 | 1.4 | 1.4 | 75.7% | 7.2% | 7.0% |
| 1-22 | 40.6 | 32.7 | 26.5 | 2.5 | 1.5 | 81.2% | 7.6% | 4.7% |
| 1-30 | 29.5 | 16.8 | 1.7 | 5.6 | 1.4 | 9.8% | 33.3% | 8.5% |
| 1-35 | 28.6 | 21.6 | 1.8 | 1.4 | 1.6 | 8.2% | 6.5% | 7.3% |
| 1-17 | 27.4 | 25.1 | 20.1 | 1.6 | 1.3 | 79.8% | 6.2% | 5.2% |
| 1-27 | 27.2 | 1.5 | 1.9 | 1.3 | 1.6 | 124.5% | 84.8% | 108.8% |
| 1-37 | 27.0 | 11.6 | 2.0 | 5.4 | 1.4 | 17.7% | 46.7% | 12.3% |
| 1-12 | 25.7 | 1.7 | 1.7 | 1.3 | 1.7 | 104.0% | 79.6% | 102.5% |
| 1-2 | 24.2 | 1.8 | 1.9 | 1.7 | 1.7 | 103.3% | 95.4% | 93.5% |
| 1-3 | 23.9 | 1.6 | 1.8 | 1.5 | 1.5 | 109.3% | 91.2% | 91.9% |
| 1-23 | 23.1 | 5.1 | 3.6 | 1.6 | 1.6 | 70.9% | 31.1% | 32.0% |
| 1-7 | 22.5 | 6.8 | 3.3 | 1.7 | 1.6 | 48.7% | 24.8% | 23.0% |
| 1-31 | 20.7 | 30.4 | 1.3 | 15.7 | 1.2 | 4.3% | 51.6% | 3.8% |
| 1-4 | 20.6 | 1.0 | 1.4 | 0.9 | 1.1 | 137.5% | 90.8% | 105.3% |
| 1-38 | 20.2 | 1.1 | 1.5 | 0.9 | 1.1 | 127.9% | 82.8% | 100.9% |
| 1-8 | 19.3 | 12.0 | 11.2 | 1.1 | 1.2 | 92.9% | 8.8% | 10.3% |
| 1-9 | 18.5 | 10.7 | 9.8 | 0.9 | 1.0 | 91.1% | 8.7% | 9.3% |
| 1-32 | 17.9 | 11.5 | 1.5 | 4.0 | 1.1 | 13.1% | 35.3% | 9.5% |
| 1-33 | 17.6 | 7.1 | 1.5 | 3.0 | 1.0 | 21.1% | 42.1% | 14.6% |
| 1-24 | 32.9 | 12.9 | 11.0 | 1.1 | 1.3 | 85.4% | 8.9% | 10.3% |
| 1-39 | 24.4 | 18.6 | 11.6 | 2.5 | 1.3 | 62.5% | 13.2% | 6.7% |
| 1-40 | 22.9 | 18.7 | 14.3 | 1.3 | 1.1 | 76.7% | 7.1% | 6.0% |
| 1-5 | 20.6 | 1.5 | 1.6 | 1.2 | 1.4 | 107.8% | 82.9% | 92.0% |
| 1-41 | 18.1 | 4.5 | 2.7 | 1.3 | 1.2 | 58.8% | 28.9% | 26.3% |
| 1-28 | 17.7 | 1.0 | 1.1 | 1.1 | 1.2 | 112.9% | 109.7% | 124.1% |
| 1-10 | 16.9 | 17.4 | 17.4 | 1.3 | 1.1 | 100.5% | 7.3% | 6.2% |
| 2-1 | 45.3 | 39.3 | 36.8 | 20.2 | 1.5 | 93.7% | 51.3% | 3.9% |
| 2-10 | 43.8 | 38.9 | 39.9 | 9.4 | 1.2 | 102.7% | 24.1% | 3.1% |
| 2-5 | 30.8 | 38.3 | 35.9 | 24.3 | 1.1 | 93.7% | 63.3% | 3.0% |
| 2-2 | 23.4 | 39.4 | 39.6 | 4.7 | 1.1 | 100.4% | 12.0% | 2.8% |
| 3-10 | 17.4 | 1.2 | 1.2 | 1.2 | 1.1 | 97.2% | 99.6% | 93.3% |
| 1-26 | 19.5 | 1.4 | 1.1 | 1.3 | 1.0 | 76.8% | 98.0% | 74.7% |
| 1-42 | 34.5 | 22.7 | 20.8 | 1.4 | 1.0 | 91.4% | 6.4% | 4.2% |
| 1-13 | 28.2 | 4.8 | 4.3 | 0.9 | 1.2 | 89.3% | 18.4% | 24.2% |
| 1-43 | 21.9 | 6.7 | 5.8 | 3.9 | 1.0 | 87.3% | 58.3% | 14.5% |

TABLE 6A-continued

SARS-CoV-2 Phage ELISA

| Variant | Column A ELISA (Avg) | Column B Acro S1 | S1-RBD-Fc | S1-Fc | S1-RBM-Fc | Column C S1-RBD-Fc | S1-Fc | S1-RBM-Fc |
|---|---|---|---|---|---|---|---|---|
| 1-44 | 24.6 | 10.4 | 8.2 | 1.0 | 0.8 | 78.6% | 9.6% | 7.6% |
| 1-14 | 21.7 | 16.8 | 13.5 | 1.1 | 0.9 | 80.6% | 6.7% | 5.4% |
| 1-6 | 20.8 | 1.8 | 1.3 | 1.1 | 0.8 | 69.6% | 60.5% | 45.4% |
| 1-45 | 24.0 | 12.1 | 10.3 | 1.2 | 1.0 | 85.3% | 9.6% | 8.3% |
| 1-46 | 21.7 | 4.6 | 3.1 | 1.1 | 0.9 | 66.6% | 24.5% | 19.8% |
| 1-20 | 26.0 | 5.7 | 3.9 | 1.0 | 0.8 | 67.3% | 17.0% | 14.5% |
| 1-47 | 22.6 | 8.1 | 5.5 | 1.2 | 0.9 | 68.9% | 14.6% | 11.1% |
| 1-29 | 23.8 | 1.1 | 0.9 | 1.0 | 0.9 | 81.4% | 94.0% | 78.3% |
| 1-1 | 32.5 | 4.5 | 4.0 | 1.6 | 1.1 | 90.7% | 35.3% | 24.5% |
| 1-19 | 22.3 | 24.2 | 23.9 | 1.5 | 1.2 | 98.7% | 6.4% | 4.9% |
| 1-16 | 22.1 | 3.4 | 3.1 | 1.0 | 0.9 | 89.7% | 29.5% | 27.3% |
| 1-34 | 28.7 | 7.5 | 3.1 | 1.8 | 1.0 | 41.3% | 24.5% | 13.3% |
| 1-48 | 22.6 | 2.5 | 2.1 | 0.8 | 0.8 | 84.7% | 31.5% | 30.3% |
| 1-49 | 27.6 | 1.0 | 1.0 | 0.8 | 0.8 | 99.3% | 85.6% | 78.8% |
| 1-18 | 22.7 | 9.8 | 7.0 | 1.1 | 0.8 | 71.0% | 11.0% | 8.0% |
| 1-11 | 33.2 | 4.8 | 4.8 | 0.9 | 1.0 | 99.5% | 18.7% | 20.6% |
| 1-50 | 21.1 | 13.9 | 12.4 | 1.2 | 0.8 | 88.9% | 8.8% | 5.9% |
| 1-25 | 27.9 | 3.6 | 2.7 | 1.0 | 0.8 | 75.4% | 28.1% | 22.3% |
| 1-36 | 23.6 | 10.1 | 1.2 | 1.1 | 0.8 | 11.5% | 10.6% | 8.4% |
| 1-15 | 24.8 | 2.5 | 1.4 | 1.0 | 0.8 | 55.4% | 41.5% | 32.1% |
| 2-4 | 15.5 | 37.7 | 38.8 | 7.2 | 1.2 | 102.7% | 19.0% | 3.1% |
| 2-6 | 22.1 | 11.1 | 12.8 | 1.8 | 1.1 | 115.8% | 16.4% | 9.5% |
| 2-11 | 28.1 | 1.1 | 1.0 | 1.2 | 0.9 | 86.3% | 103.4% | 76.1% |
| 2-12 | 18.2 | 39.8 | 40.3 | 14.7 | 1.1 | 101.3% | 37.0% | 2.9% |
| 2-13 | 19.1 | 27.3 | 32.1 | 3.7 | 0.9 | 117.5% | 13.4% | 3.1% |
| 2-14 | 17.2 | 31.7 | 32.9 | 4.2 | 0.9 | 103.9% | 13.3% | 2.8% |
| 2-7 | 25.3 | 37.2 | 37.3 | 7.7 | 0.9 | 100.3% | 20.6% | 2.4% |
| 2-8 | 32.4 | 35.9 | 36.5 | 5.4 | 1.1 | 101.8% | 15.0% | 3.1% |
| 2-15 | 13.7 | 31.0 | 28.1 | 3.8 | 0.9 | 90.6% | 12.4% | 3.0% |
| 2-9 | 14.1 | 24.1 | 24.3 | 3.0 | 0.8 | 100.7% | 12.2% | 3.5% |

Figure 10:
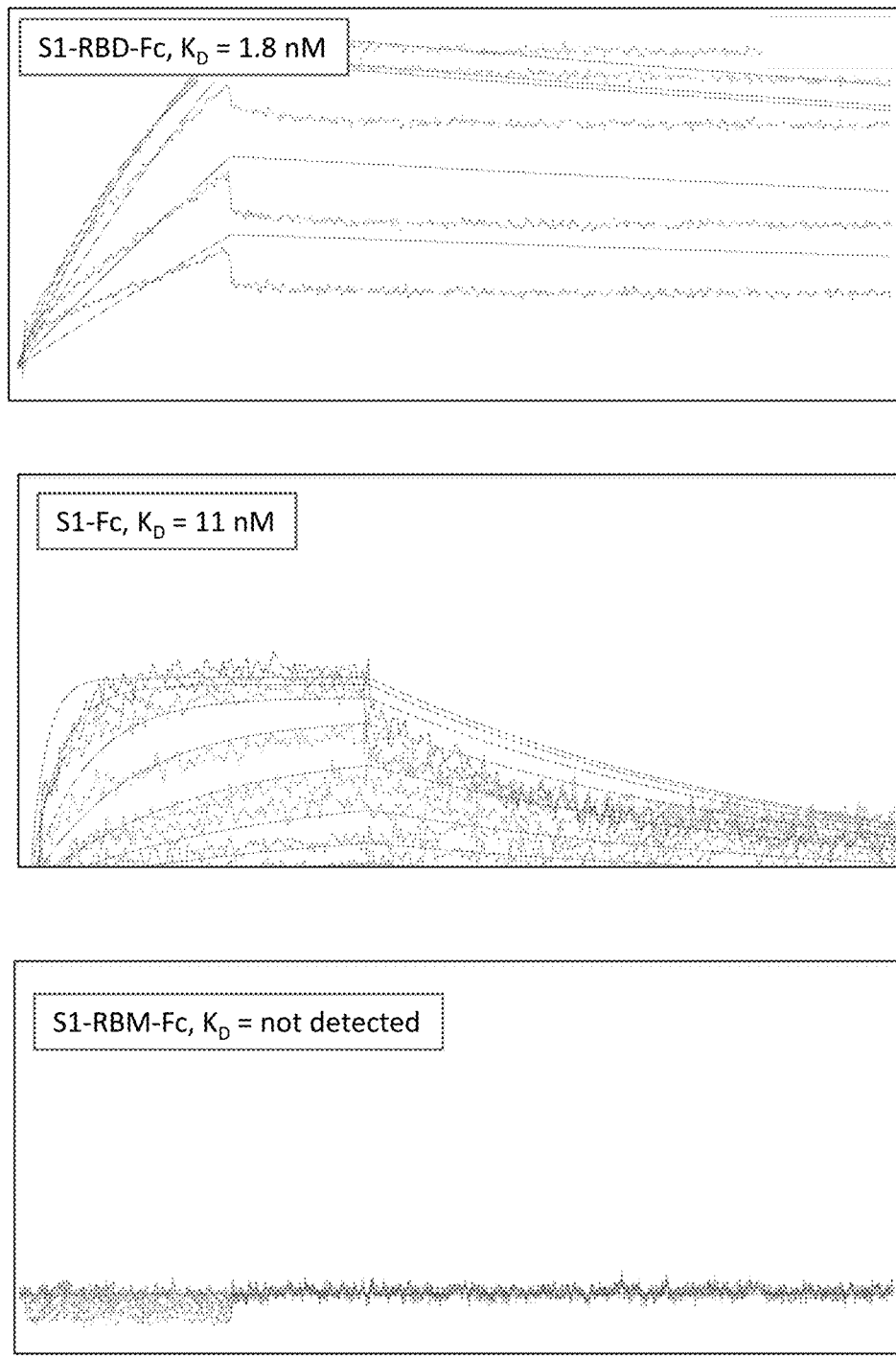
FIG. 10 shows graphs of ACE2 binding to SARS-CoV-2 variant antibodies.

Tables 6B-6C show Carterra SPR kinetics for SARS-CoV-2 variant antibodies ranked by off-rate (Table 6B) and by $K_D$ (Table 6C). Tables 6D-6E show Carterra SPR kinetics for ACE2 variant antibodies ranked by off-rate (Table 6D) and by $K_D$ (Table 6E). FIG. 10 shows that ACE2 binds to S1-RBD-Fc and S1-Fc variants.

TABLE 6B

SARS-CoV-2 Carterra SPR Kinetics Ranked by Off-Rate

| IgG | Acro S1 | S1-RBD-Fc | S1-Fc | S1-RBM-Fc | ka (M-1 s-1) | Kd (s-1) |
|---|---|---|---|---|---|---|
| 2-10 | 38.9 | 39.9 | 9.4 | 1.2 | 2.08E+05 | 1.15E−04 |
| 2-5 | 38.3 | 35.9 | 24.3 | 1.1 | 9.39E+04 | 2.59E−04 |
| 1-31 | 30.4 | 1.3 | 15.7 | 1.2 | 2.05E+04 | 7.62E−04 |
| 2-2 | 39.4 | 39.6 | 4.7 | 1.1 | 7.74E+04 | 9.06E−04 |
| 1-13 | 4.8 | 4.3 | 0.9 | 1.2 | 2.17E+05 | 1.38E−03 |
| 1-30 | 16.8 | 1.7 | 5.6 | 1.4 | 4.39E+04 | 1.64E−03 |
| 1-29 | 1.1 | 0.9 | 1.0 | 0.9 | 5.35E+02 | 1.97E−03 |
| 1-27 | 1.5 | 1.9 | 1.3 | 1.6 | 2.27E+05 | 2.85E−03 |
| 1-35 | 21.6 | 1.8 | 1.4 | 1.6 | 5.90E+04 | 5.43E−03 |
| 1-36 | 10.1 | 1.2 | 1.1 | 0.8 | 1.14E+05 | 7.85E−03 |
| 1-67 | 18.6 | 11.6 | 2.5 | 1.3 | 7.36E+04 | 8.86E−03 |
| 1-2 | 1.8 | 1.9 | 1.7 | 1.7 | 1.58E+03 | 2.72E−02 |
| 1-5 | 1.5 | 1.6 | 1.2 | 1.4 | 2.15E+03 | 5.40E−02 |
| 1-68 | 6.7 | 5.8 | 3.9 | 1.0 | 2.46E+06 | 8.75E−02 |
| 1-69 | 1.1 | 1.5 | 0.9 | 1.2 | 3.08E+05 | 1.23E−01 |
| 1-4 | 1.0 | 1.4 | 0.9 | 1.1 | 4.20E+04 | 1.24E−01 |
| 1-12 | 1.7 | 1.7 | 1.3 | 1.7 | 3.59E+05 | 1.34E−01 |
| 1-11 | 4.8 | 4.8 | 0.9 | 1.0 | 5.92E+05 | 1.43E−01 |
| 1-10 | 17.4 | 17.4 | 1.3 | 1.1 | 1.04E+06 | 1.47E−01 |
| 1-7 | 4.5 | 2.7 | 1.3 | 1.2 | 2.09E+05 | 1.55E−01 |

TABLE 6B-continued

SARS-CoV-2 Carterra SPR Kinetics Ranked by Off-Rate

| IgG | Acro S1 | S1-RBD-Fc | S1-Fc | S1-RBM-Fc | ka (M-1 s-1) | Kd (s-1) |
|---|---|---|---|---|---|---|
| 1-15 | 2.5 | 1.4 | 1.0 | 0.8 | 4.49E+05 | 1.56E−01 |
| 1-25 | 3.6 | 2.7 | 1.0 | 0.8 | 1.98E+06 | 1.56E−01 |
| 1-23 | 5.1 | 3.6 | 1.6 | 1.6 | 5.06E+05 | 1.59E−01 |
| 1-7 | 6.8 | 3.3 | 1.7 | 1.6 | 1.34E+06 | 1.70E−01 |
| 1-47 | 8.1 | 5.5 | 1.2 | 0.9 | 6.32E+03 | 2.40E−01 |
| 1-3 | 1.6 | 1.8 | 1.5 | 1.5 | 1.42E+06 | 3.04E−01 |
| 1-32 | 11.5 | 1.5 | 4.0 | 1.1 | 5.49E+06 | 3.17E−01 |
| 1-20 | 5.7 | 3.9 | 1.0 | 0.8 | 5.17E+02 | 6.95E−01 |
| 1-28 | 1.0 | 1.1 | 1.1 | 1.2 | 1.23E+08 | 9.05E+00 |
| 1-48 | 2.5 | 2.1 | 0.8 | 0.8 | 5.56E+07 | 9.11E+00 |
| 1-24 | 12.9 | 11.0 | 1.1 | 1.3 | 1.94E+08 | 1.46E+01 |
| 1-6 | 1.8 | 1.3 | 1.1 | 0.8 | 4.49E+08 | 2.08E+01 |
| 1-17 | 25.1 | 20.1 | 1.6 | 1.3 | 3.92E+08 | 2.63E+01 |
| 1-49 | 1.0 | 1.0 | 0.8 | 0.8 | 6.00E+08 | 3.22E+01 |
| 1-71 | 11.6 | 2.0 | 5.4 | 1.4 | 3.69E+08 | 4.03E+01 |
| 1-42 | 22.7 | 20.8 | 1.4 | 1.0 | 9.10E+08 | 1.03E+02 |

TABLE 6C

SARS-CoV-2 Carterra SPR Kinetics Ranked by $K_D$

| IgG | Acro S1 | S1-RBD-Fc | S1-Fc | S1-RBM-Fc | ka (M-1 s-1) | kd (s-1) | $K_D$ (nM) | Rmax (RU) |
|---|---|---|---|---|---|---|---|---|
| 2-10 | 38.9 | 39.9 | 9.4 | 1.2 | 2.08E+05 | 1.15E−04 | 0.6 | 20 |
| 2-5 | 38.3 | 35.9 | 24.3 | 1.1 | 9.39E+04 | 2.59E−04 | 2.8 | 39 |
| 1-13 | 4.8 | 4.3 | 0.9 | 1.2 | 2.17E+05 | 1.38E−03 | 6.4 | 23 |
| 2-2 | 39.4 | 39.6 | 4.7 | 1.1 | 7.74E+04 | 9.06E−04 | 11.7 | 131 |
| 1-27 | 1.5 | 1.9 | 1.3 | 1.6 | 2.27E+05 | 2.85E−03 | 12.5 | 39 |
| 1-68 | 6.7 | 5.8 | 3.9 | 1.0 | 2.46E+06 | 8.75E−02 | 35.6 | 73 |
| 1-30 | 16.8 | 1.7 | 5.6 | 1.4 | 4.39E+04 | 1.64E−03 | 37.2 | 98 |
| 1-31 | 30.4 | 1.3 | 15.7 | 1.2 | 2.05E+04 | 7.62E−04 | 37.2 | 256 |
| 1-6 | 1.8 | 1.3 | 1.1 | 0.8 | 4.49E+08 | 2.08E+01 | 46.3 | 87 |
| 1-49 | 1.0 | 1.0 | 0.8 | 0.8 | 6.00E+08 | 3.22E+01 | 53.6 | 72 |
| 1-32 | 11.5 | 1.5 | 4.0 | 1.1 | 5.49E+06 | 3.17E−01 | 57.8 | 112 |
| 1-17 | 25.1 | 20.1 | 1.6 | 1.3 | 3.92E+08 | 2.63E+01 | 67.1 | 46 |
| 1-36 | 10.1 | 1.2 | 1.1 | 0.8 | 1.14E+05 | 7.85E−03 | 68.9 | 150 |
| 1-28 | 1.0 | 1.1 | 1.1 | 1.2 | 1.23E+08 | 9.05E+00 | 73.5 | 58 |
| 1-24 | 12.9 | 11.0 | 1.1 | 1.3 | 1.94E+08 | 1.46E+01 | 75.5 | 48 |
| 1-25 | 3.6 | 2.7 | 1.0 | 0.8 | 1.98E+06 | 1.56E−01 | 78.9 | 46 |
| 1-35 | 21.6 | 1.8 | 1.4 | 1.6 | 5.90E+04 | 5.43E−03 | 91.9 | 341 |
| 1-71 | 11.6 | 2.0 | 5.4 | 1.4 | 3.69E+08 | 4.03E+01 | 109.3 | 113 |
| 1-42 | 22.7 | 20.8 | 1.4 | 1.0 | 9.10E+08 | 1.03E+02 | 113.4 | 68 |
| 1-67 | 18.6 | 11.6 | 2.5 | 1.3 | 7.36E+04 | 8.86E−03 | 120.4 | 22 |
| 1-7 | 6.8 | 3.3 | 1.7 | 1.6 | 1.34E+06 | 1.70E−01 | 127.1 | 31 |
| 1-10 | 17.4 | 17.4 | 1.3 | 1.1 | 1.04E+06 | 1.47E−01 | 141.7 | 27 |
| 1-48 | 2.5 | 2.1 | 0.8 | 0.8 | 5.56E+07 | 9.11E+00 | 163.8 | 64 |
| 1-3 | 1.6 | 1.8 | 1.5 | 1.5 | 1.42E+06 | 3.04E−01 | 214.6 | 87 |
| 1-11 | 4.8 | 4.8 | 0.9 | 1.0 | 5.92E+05 | 1.43E−01 | 240.9 | 53 |
| 1-23 | 5.1 | 3.6 | 1.6 | 1.6 | 5.06E+05 | 1.59E−01 | 314.6 | 128 |
| 1-15 | 2.5 | 1.4 | 1.0 | 0.8 | 4.49E+05 | 1.56E−01 | 346.9 | 79 |
| 1-12 | 1.7 | 1.7 | 1.3 | 1.7 | 3.59E+05 | 1.34E−01 | 372.5 | 112 |
| 1-69 | 1.1 | 1.5 | 0.9 | 1.2 | 3.08E+05 | 1.23E−01 | 398.4 | 66 |
| 1-7 | 4.5 | 2.7 | 1.3 | 1.2 | 2.09E+05 | 1.55E−01 | 742.5 | 160 |
| 1-4 | 1.0 | 1.4 | 0.9 | 1.1 | 4.20E+04 | 1.24E−01 | 2946.4 | 385 |
| 1-29 | 1.1 | 0.9 | 1.0 | 0.9 | 5.35E+02 | 1.97E−03 | 3684.3 | 1206 |
| 1-2 | 1.8 | 1.9 | 1.7 | 1.7 | 1.58E+03 | 2.72E−02 | 17228.5 | 1652 |
| 1-5 | 1.5 | 1.6 | 1.2 | 1.4 | 2.15E+03 | 5.40E−02 | 25170.1 | 4457 |
| 1-47 | 8.1 | 5.5 | 1.2 | 0.9 | 6.32E+03 | 2.40E−01 | 37971.0 | 5497 |
| 1-20 | 5.7 | 3.9 | 1.0 | 0.8 | 5.17E+02 | 6.95E−01 | 1344113.2 | 64406 |

TABLE 6D

ACE2 Carterra SPR Kinetics Ranked by Off-Rate

| IgG | ka (M-1 s-1) | kd (s-1) |
|---|---|---|
| 4-29 | 1.66E+05 | 4.20E−04 |
| 4-33 | 2.29E+05 | 5.52E−04 |
| 4-89 | 2.04E+06 | 6.11E−04 |
| 4-18 | 6.61E+05 | 6.14E−04 |
| 4-6 | 4.84E+05 | 6.79E−04 |
| 4-64 | 2.90E+06 | 7.00E−04 |
| 4-2 | 1.40E+06 | 9.60E−04 |
| 4-49 | 2.91E+06 | 9.80E−04 |
| 4-45 | 8.03E+05 | 9.88E−04 |
| 4-41 | 1.80E+05 | 1.00E−03 |
| 4-63 | 6.10E+05 | 1.05E−03 |
| 4-73 | 2.27E+05 | 1.47E−03 |
| 4-52 | 1.26E+05 | 1.49E−03 |
| 4-5 | 3.22E+03 | 1.53E−03 |
| 4-12 | 2.51E+05 | 1.80E−03 |
| 4-14 | 1.32E+05 | 1.92E−03 |
| 4-46 | 7.87E+04 | 1.95E−03 |
| 4-7 | 1.61E+05 | 1.96E−03 |
| 3-15 | 1.53E+05 | 2.06E−03 |
| 4-67 | 9.39E+04 | 2.14E−03 |
| 4-56 | 1.30E+05 | 2.37E−03 |
| 3-3 | 3.28E+05 | 2.38E−03 |
| 4-57 | 3.07E+05 | 2.39E−03 |
| 3-14 | 1.72E+03 | 2.50E−03 |
| 4-69 | 9.94E+04 | 2.56E−03 |
| 4-78 | 2.47E+05 | 2.63E−03 |
| 4-3 | 5.33E+04 | 2.68E−03 |
| 4-34 | 5.25E+05 | 2.73E−03 |
| 4-20 | 3.54E+04 | 2.76E−03 |
| 4-31 | 2.17E+05 | 2.77E−03 |
| 4-74 | 2.48E+05 | 2.85E−03 |
| 4-61 | 3.48E+05 | 2.86E−03 |
| 4-25 | 7.87E+04 | 3.03E−03 |
| 4-82 | 3.01E+05 | 3.33E−03 |
| 4-62 | 2.45E+05 | 3.65E−03 |
| 4-21 | 3.16E+04 | 4.18E−03 |
| 4-76 | 1.35E+05 | 4.28E−03 |
| 4-75 | 2.99E+05 | 4.78E−03 |
| 3-6 | 2.23E+05 | 4.88E−03 |
| 3-8 | 1.14E+05 | 5.09E−03 |
| 3-7 | 4.69E+05 | 5.20E−03 |
| 3-9 | 8.36E+04 | 5.69E−03 |
| 4-32 | 1.26E+05 | 5.74E−03 |
| 3-12 | 1.55E+04 | 6.49E−03 |
| 4-9 | 2.86E+05 | 6.81E−03 |
| 4-95 | 4.15E+05 | 7.72E−03 |
| 3-11 | 2.69E+05 | 9.45E−03 |
| 3-13 | 8.09E+04 | 1.02E−02 |
| 4-15 | 5.54E+05 | 1.10E−02 |
| 4-39 | 1.36E+05 | 1.37E−02 |
| 3-10 | 2.22E+03 | 2.00E−02 |
| 4-42 | 8.79E+06 | 1.16E−01 |

TABLE 6E

| ACE2 Carterra SPR Kinetics Ranked by $K_D$ | | | | |
|---|---|---|---|---|
| IgG | ka (M-1 s-1) | kd (s-1) | $K_D$ (nM) | Rmax (RU) |
| 4-64 | 2.90E+06 | 7.00E−04 | 0.2 | 115 |
| 4-89 | 2.04E+06 | 6.11E−04 | 0.3 | 66 |
| 4-49 | 2.91E+06 | 9.80E−04 | 0.3 | 71 |
| 4-2 | 1.40E+06 | 9.60E−04 | 0.7 | 70 |
| 4-18 | 6.61E+05 | 6.14E−04 | 0.9 | 121 |
| 4-45 | 8.03E+05 | 9.88E−04 | 1.2 | 148 |
| 4-6 | 4.84E+05 | 6.79E−04 | 1.4 | 147 |
| 4-63 | 6.10E+05 | 1.05E−03 | 1.7 | 89 |
| 4-33 | 2.29E+05 | 5.52E−04 | 2.4 | 98 |
| 4-29 | 1.66E+05 | 4.20E−04 | 2.5 | 72 |
| 4-34 | 5.25E+05 | 2.73E−03 | 5.2 | 85 |
| 4-41 | 1.80E+05 | 1.00E−03 | 5.6 | 154 |
| 4-73 | 2.27E+05 | 1.47E−03 | 6.5 | 231 |
| 4-12 | 2.51E+05 | 1.80E−03 | 7.2 | 84 |
| 3-3 | 3.28E+05 | 2.38E−03 | 7.3 | 340 |
| 4-57 | 3.07E+05 | 2.39E−03 | 7.8 | 388 |
| 4-61 | 3.48E+05 | 2.86E−03 | 8.2 | 294 |
| 4-78 | 2.47E+05 | 2.63E−03 | 10.7 | 118 |
| 4-82 | 3.01E+05 | 3.33E−03 | 11.1 | 158 |
| 3-7 | 4.69E+05 | 5.20E−03 | 11.1 | 105 |
| 4-74 | 2.48E+05 | 2.85E−03 | 11.5 | 166 |
| 4-52 | 1.26E+05 | 1.49E−03 | 11.8 | 110 |
| 4-7 | 1.61E+05 | 1.96E−03 | 12.2 | 257 |
| 4-31 | 2.17E+05 | 2.77E−03 | 12.8 | 280 |
| 4-42 | 8.79E+06 | 1.16E−01 | 13.2 | 64 |
| 3-15 | 1.53E+05 | 2.06E−03 | 13.5 | 151 |
| 4-14 | 1.32E+05 | 1.92E−03 | 14.5 | 290 |
| 4-62 | 2.45E+05 | 3.65E−03 | 14.9 | 111 |
| 4-75 | 2.99E+05 | 4.78E−03 | 16.0 | 87 |
| 4-56 | 1.30E+05 | 2.37E−03 | 18.2 | 264 |
| 4-95 | 4.15E+05 | 7.72E−03 | 18.6 | 97 |
| 4-15 | 5.54E+05 | 1.10E−02 | 19.8 | 106 |
| 3-6 | 2.23E+05 | 4.88E−03 | 21.9 | 162 |
| 4-67 | 9.39E+04 | 2.14E−03 | 22.8 | 130 |
| 4-9 | 2.86E+05 | 6.81E−03 | 23.8 | 109 |
| 4-46 | 7.87E+04 | 1.95E−03 | 24.7 | 81 |
| 4-69 | 9.94E+04 | 2.56E−03 | 25.8 | 59 |
| 4-76 | 1.35E+05 | 4.28E−03 | 31.8 | 144 |
| 3-11 | 2.69E+05 | 9.45E−03 | 35.1 | 113 |
| 4-25 | 7.87E+04 | 3.03E−03 | 38.5 | 78 |
| 3-8 | 1.14E+05 | 5.09E−03 | 44.6 | 161 |
| 4-32 | 1.26E+05 | 5.74E−03 | 45.6 | 66 |
| 4-3 | 5.33E+04 | 2.68E−03 | 50.3 | 117 |
| 3-9 | 8.36E+04 | 5.69E−03 | 68.0 | 176 |
| 4-20 | 3.54E+04 | 2.76E−03 | 77.9 | 76 |
| 4-39 | 1.36E+05 | 1.37E−02 | 100.7 | 193 |
| 3-13 | 8.09E+04 | 1.02E−02 | 126.2 | 77 |
| 4-21 | 3.16E+04 | 4.18E−03 | 132.2 | 39 |
| 3-12 | 1.55E+04 | 6.49E−03 | 420.2 | 106 |
| 4-5 | 3.22E+03 | 1.53E−03 | 473.6 | 196 |
| 3-14 | 1.72E+03 | 2.50E−03 | 1452.3 | 300 |
| 3-10 | 2.22E+03 | 2.00E−02 | 8999.0 | 1681 |

Example 5. SARS-CoV-2 and ACE Variants

SARS-CoV-2 and ACE variant antibodies were tested for specificity and affinity.

Recombinant S1 Protein (Acros Biosystems Cat. No. S1N-S52H5) was passively immobilized on a 384 well ELISA plate and blocked with BSA. The S1 Panel antibodies were diluted from 50 nM to 0.0076 nM and incubated with the blocked plate. Antibody binding was detected using Goat-anti-Human-HRP secondary and developed with HRP substrate (list here). The absorbance signal was plotted as % of maximal binding and fitted to determine the EC50 of each antibody using GraphPad Prism.

Figure 11A:
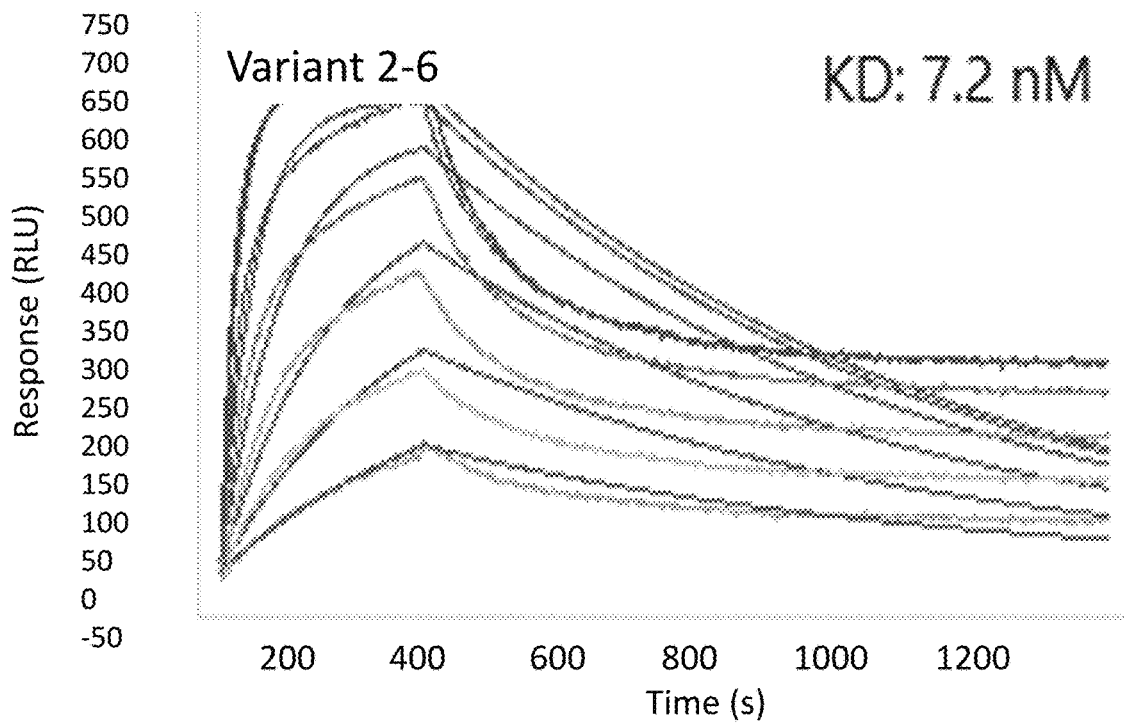
FIGS. 11A-11B are graphs of affinity data for SARS-CoV-2 variant antibodies.
Figure 11B:
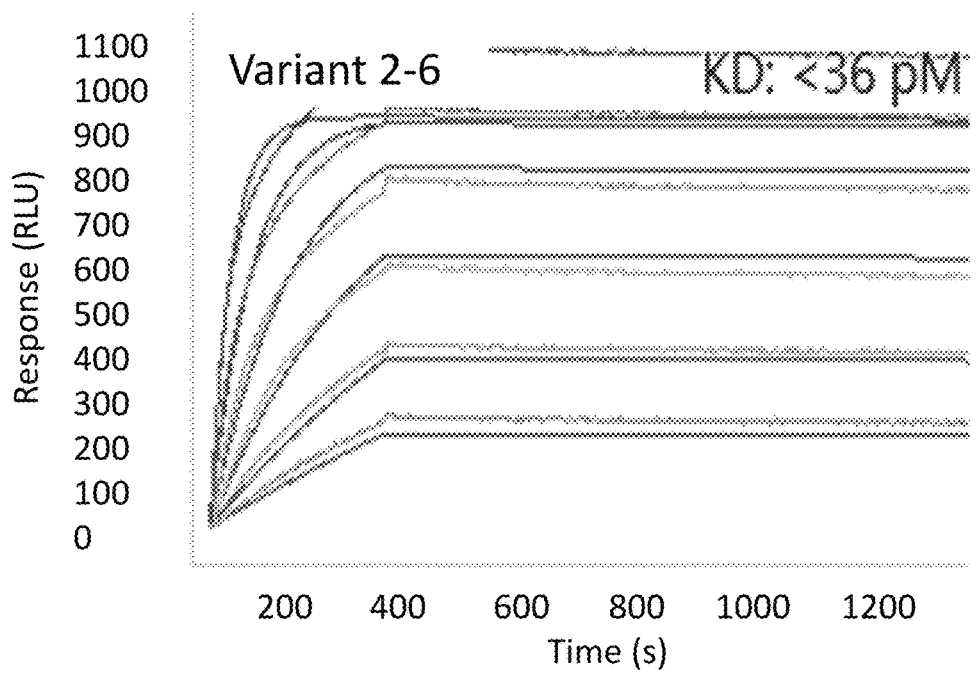
Figure 12A:
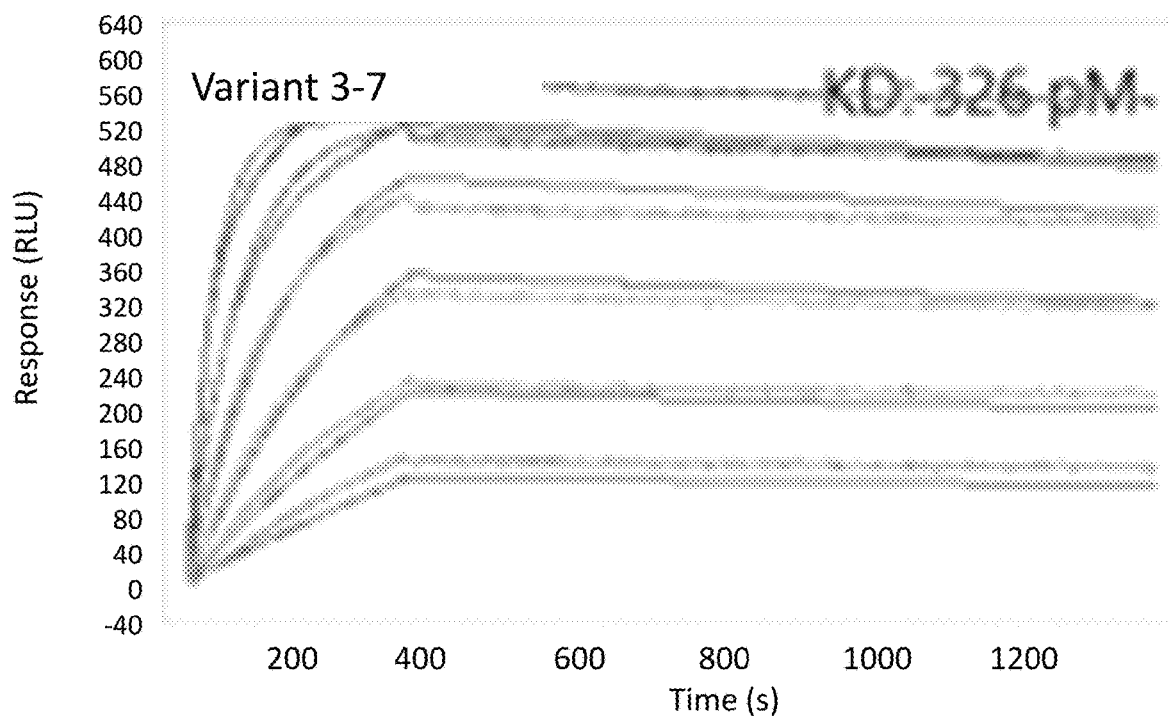
FIGS. 12A-12C are graphs of affinity data for ACE2 variant antibodies.
Figure 12B:
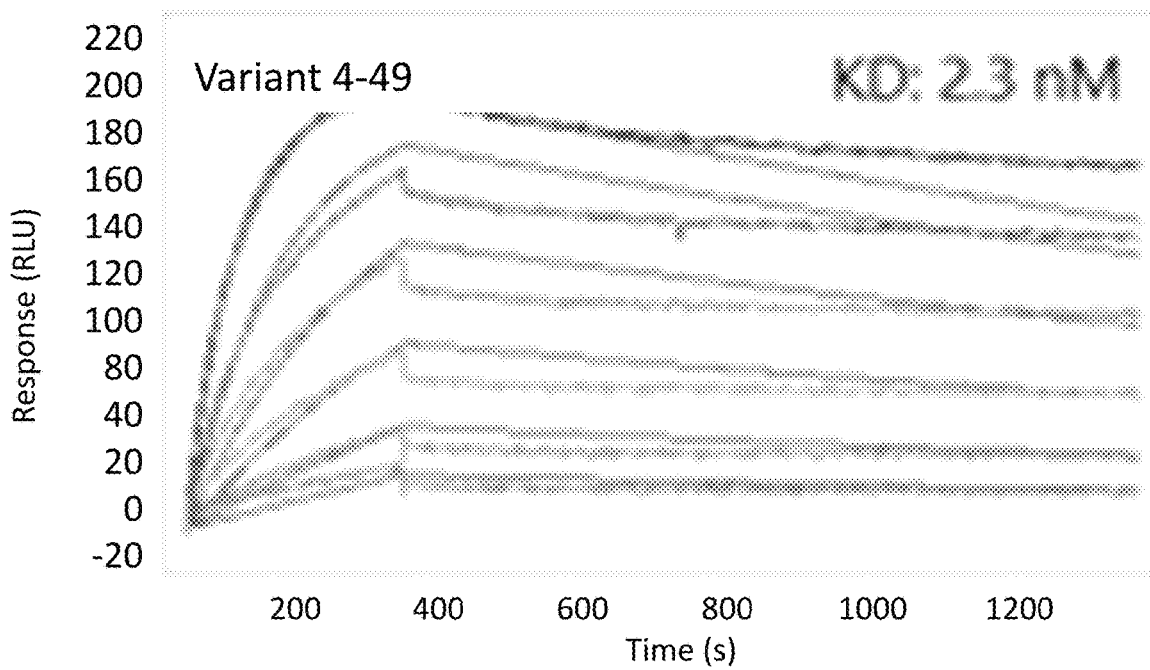
Figure 12C:
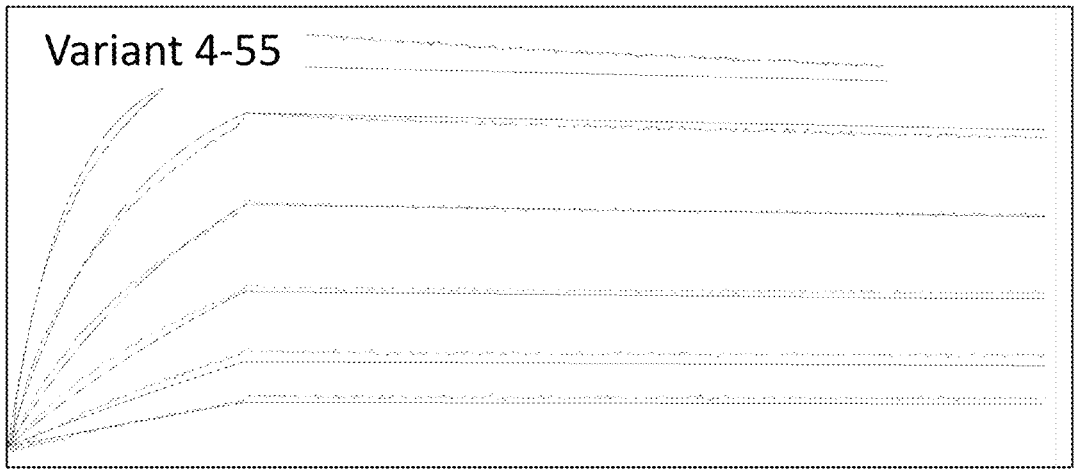
Figure 13:
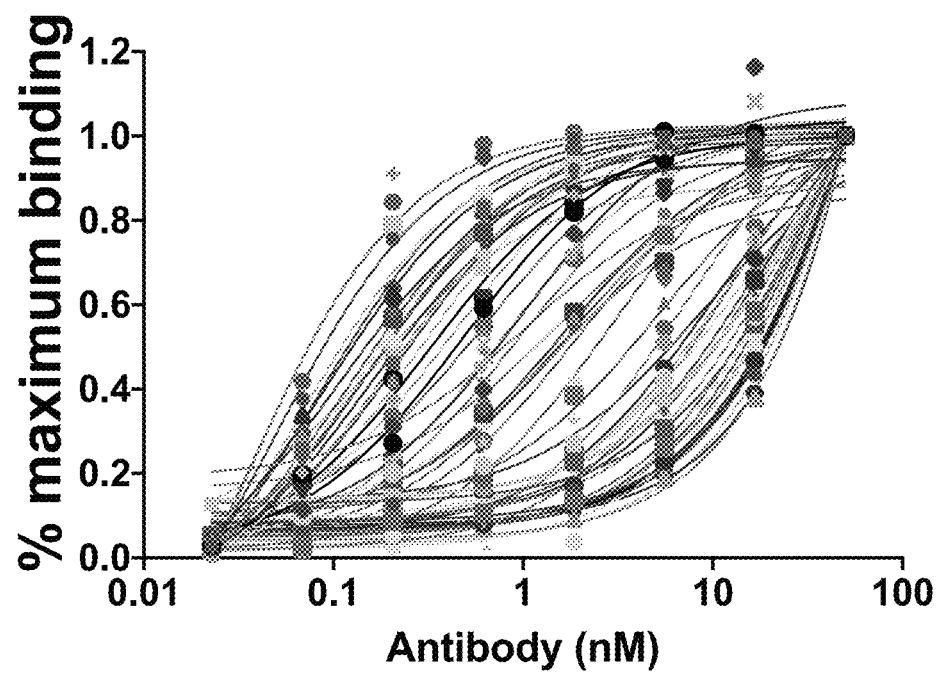
FIG. 13 is a graph of binding of SARS-CoV-2 variant antibodies to S1 protein.

Exemplary data for affinity of SARS-CoV-2 variant 2-6 is seen in FIGS. 11A-11B and ACE2 variants 3-7 (FIG. 12A), 4-49 (FIG. 12B), and 4-55 (FIG. 12C). The binding of SARS-CoV-2 panel of antibodies was measured as seen in FIG. 13 and Tables 7A-7F below.

TABLE 7A

| SARS-CoV-2 Variants EC50 | |
|---|---|
| Antibody | EC50 (nM) |
| 1-31 | 0.03139 |
| 2-6 | 0.03364 |
| ACRO | 0.04831 |
| 1-34 | 0.06522 |
| 2-2 | 0.07992 |
| 1-27 | 0.09283 |
| 2-8 | 0.1029 |
| 1-22 | 0.1248 |
| 1-32 | 0.1406 |
| 1-16 | 0.1435 |
| 1-12 | 0.1585 |
| 2-5 | 0.1615 |
| CR3022 | 0.1657 |
| 1-53 | 0.1691 |
| 1-30 | 0.2084 |
| 1-28 | 0.2224 |
| 1-71 | 0.2673 |
| 1-20 | 0.3236 |
| 1-4 | 0.4216 |
| 1-35 | 0.4922 |
| 1-47 | 0.5893 |
| 1-5 | 0.774 |
| 2-4 | 0.8792 |
| 1-3 | 0.9724 |
| 1-21 | 1.003 |
| 2-19 | 1.257 |
| 1-51 | 1.465 |
| 1-19 | 1.706 |
| 1-42 | 1.742 |
| 2-2 | 1.789 |
| 2-1 | 1.894 |
| 1-33 | 3.006 |
| 2-13 | 5.139 |
| 2-11 | 6.921 |
| 2-15 | 8.509 |
| 2-7 | 10.09 |
| 1-26 | 11.93 |
| 1-24 | 12.86 |
| 1-49 | 13.04 |
| 1-10 | 18.31 |
| 1-1 | 21.87 |
| 1-8 | 25.09 |
| 1-7 | 26.94 |
| 1-72 | 29.13 |
| 1-17 | 33.17 |
| 1-36 | 34.86 |
| 1-73 | 43.58 |
| 2-10 | 46.43 |
| 1-9 | 46.88 |
| 2-17 | 51.86 |
| 1-52 | 57.88 |
| 2-18 | 74.71 |
| 1-29 | 83.41 |
| 2-12 | 95.94 |
| 1-25 | 107 |
| 2-9 | 118.3 |
| 1-23 | 123.9 |
| 1-48 | 296 |
| 2-14 | 854.7 |

TABLE 7B

| SARS-CoV-2 Variants Frequency and ELISA Data | | |
|---|---|---|
| IgG | Freq. | ELISA (Avg) |
| 1-21 | 1 | 47.6 |
| 1-22 | 3 | 40.6 |
| 1-30 | 1 | 29.5 |
| 1-35 | 3 | 28.6 |
| 1-17 | 79 | 27.4 |
| 1-27 | 1 | 27.2 |

TABLE 7B-continued

SARS-CoV-2 Variants Frequency and ELISA Data

| IgG | Freq. | ELISA (Avg) |
|---|---|---|
| 1-12 | 2 | 25.7 |
| 1-2 | 14 | 24.2 |
| 1-3 | 2 | 23.9 |
| 1-23 | 1 | 23.1 |
| 1-7 | 4 | 22.5 |
| 1-31 | 1 | 20.7 |
| 1-4 | 1 | 20.6 |
| 1-8 | 2 | 19.3 |
| 1-9 | 2 | 18.5 |
| 1-32 | 1 | 17.9 |
| 1-33 | 1 | 17.6 |
| 1-24 | 1 | 32.9 |
| 1-5 | 1 | 20.6 |
| 1-28 | 2 | 17.7 |
| 1-10 | 1 | 16.9 |
| 1-26 | 1 | 19.5 |
| 1-13 | 1 | 28.2 |
| 1-14 | 1 | 21.7 |
| 1-6 | 1 | 20.8 |
| 1-20 | 3 | 26.0 |
| 1-29 | 1 | 23.8 |
| 1-1 | 1 | 32.5 |
| 1-19 | 1 | 22.3 |
| 1-16 | 1 | 22.1 |
| 1-34 | 1 | 28.7 |
| 1-18 | 1 | 22.7 |
| 1-11 | 1 | 33.2 |
| 1-25 | 1 | 27.9 |
| 1-36 | 1 | 23.6 |
| 1-15 | 1 | 24.8 |
| 1-51 | 1 | 7.1 |
| 1-52 | 1 | 3.5 |
| 1-53 | 1 | 21.7 |

TABLE 7C

SARS-CoV-2 S1 Variants

| IgG | Freq | ELISA (Avg) | DB/S1 $K_D$ (nM) | DB/S-T $K_D$ (nM) | DC/S1 $K_D$ (nM) | DC/S-T $K_D$ (nM) | Inhibitor IC50 (nM) | Fc/S1 $K_D$ (nM) | Fc/S-T $K_D$ (nM)f |
|---|---|---|---|---|---|---|---|---|---|
| 1-21 | 1 | 47.6 | | | | | 6.7 | | |
| 1-22 | 3 | 40.6 | | | | | 73.2 | | |
| 1-30 | 1 | 29.5 | 37.2 | | 4.7 | 475861.6 | 25.3 | | |
| 1-35 | 3 | 28.6 | 91.9 | 569.8 | 47.5 | 16.7 | 209.2 | 139.4 | 0.5 |
| 1-17 | 79 | 27.4 | 67.1 | | 6649.2 | | | | 10.0 |
| 1-27 | 1 | 27.2 | 12.5 | | 5519.6 | | | 9.6 | 9.6 |
| 1-12 | 2 | 25.7 | 372.5 | | 10.6 | | 33.0 | 6.1 | 14.0 |
| 1-2 | 14 | 24.2 | 17228.5 | 304.3 | | | | | |
| 1-3 | 2 | 23.9 | 214.6 | 423.0 | 252.8 | 5306.9 | 15.7 | | 10.0 |
| 1-23 | 1 | 23.1 | 314.6 | | | | | | |
| 1-7 | 4 | 22.5 | 127.1 | | | | | | |
| 1-31 | 1 | 20.7 | 37.2 | | 14.4 | | 9.2 | 17.5 | |
| 1-4 | 1 | 20.6 | 2946.4 | 6.6 | 659.2 | 129.2 | | 25.5 | 12.3 |
| 1-8 | 2 | 19.3 | | | | | 97.3 | | |
| 1-9 | 2 | 18.5 | | | | | 282.4 | | |
| 1-32 | 1 | 17.9 | 57.8 | | 14.8 | | | 2979.8 | |
| 1-33 | 1 | 17.6 | | | 8.1 | 1739312.4 | | | |
| 1-24 | 1 | 32.9 | 75.5 | | 2043.7 | | | | |
| 1-40 | 2 | 22.9 | | | | | | | |
| 1-5 | 1 | 20.6 | 25170.1 | 1155.7 | | | | | |
| 1-28 | 2 | 17.7 | 73.5 | 13.4 | 520.3 | 96.6 | | 3236.7 | 8.6 |
| 1-10 | 1 | 16.9 | 141.7 | | | | 17.7 | | |
| 1-26 | 1 | 19.5 | | | | | 8.0 | | |
| 1-13 | 1 | 28.2 | 6.4 | | | | | | |
| 1-14 | 1 | 21.7 | | 8.1 | | | | | |
| 1-6 | 1 | 20.8 | 46.3 | 684.2 | | | | | |
| 1-20 | 3 | 26.0 | 1344113.2 | | 34.4 | 145.0 | | 10.3 | 17.3 |
| 1-29 | 1 | 23.8 | 3684.3 | 36.1 | | | | | 19.3 |
| 1-1 | 1 | 32.5 | | | | | | | |
| 1-19 | 1 | 22.3 | | | 85.4 | 0.0 | | 14.3 | 18.6 |
| 1-16 | 1 | 22.1 | | | 2282.0 | 4487.3 | 1.7 | 178.8 | 2.2 |
| 1-34 | 1 | 28.7 | | | 8.2 | 623.6 | | 13.4 | 1.4 |
| 1-18 | 1 | 22.7 | | | | | | | |
| 1-11 | 1 | 33.2 | 240.9 | 30.2 | | | | | |
| 1-25 | 1 | 27.9 | 78.9 | | | | | 3.0 | |
| 1-36 | 1 | 23.6 | 68.9 | 3.9 | | | | 9.3 | 33.2 |
| 1-15 | 1 | 24.8 | 346.9 | | | | | | |
| 1-51 | 1 | 7.1 | | | | | | | |
| 1-52 | 1 | 3.5 | | | | | 739.8 | | |
| 1-53 | 1 | 21.7 | | | | | 1426.0 | | |
| 2-16 | 1 | 7.1 | | | | | 433.4 | | |
| 2-17 | 1 | 3.5 | | | | | | | |
| 2-18 | 1 | 43.0 | | | | | | | |
| 2-19 | 1 | 21.7 | | | | | | | |
| 2-2 | 1 | 12.8 | | | | | | | |

TABLE 7D

SARS-CoV-2 S1 Variants Frequency and ELISA Data

| IgG | Freq. | ELISA(Avg) |
|---|---|---|
| 2-1 | 1 | 45.3 |
| 2-10 | 1 | 43.8 |
| 2-5 | 46 | 30.8 |
| 2-2 | 2 | 23.4 |
| 2-4 | 1 | 15.5 |
| 2-6 | 5 | 22.1 |
| 2-11 | 3 | 28.1 |
| 2-12 | 1 | 18.2 |
| 2-13 | 1 | 19.1 |
| 2-14 | 1 | 17.2 |
| 2-7 | 1 | 25.3 |
| 2-8 | 1 | 32.4 |
| 2-15 | 1 | 13.7 |
| 2-9 | 1 | 14.1 |
| 2-16 | 1 | 7.1 |
| 2-17 | 1 | 3.5 |
| 2-18 | 1 | 43.0 |
| 2-19 | 1 | 21.7 |
| 2-2 | 1 | 12.8 |

TABLE 7E

SARS-CoV-2 S1 Variants

| IgG | Freq | ELISA (Avg) | DB/S1 $K_D$ (nM) | DB/S-T $K_D$ (nM) | DC/S1 $K_D$ (nM) | DC/S-T $K_D$ (nM) | Inhibitor IC50 (nM) | Fc/S1 $K_D$ (nM) | Fc/S-T $K_D$ (nM) |
|---|---|---|---|---|---|---|---|---|---|
| 2-10 | 1 | 43.8 | 0.6 | 125.6 | | | | | |
| 2-5 | 46 | 30.8 | 2.8 | | | | 17.3 | 4.2 | 1.9 | 90.2 |
| 2-2 | 2 | 23.4 | 11.7 | 1.2 | | 1.4 | 3.6 | 58.3 | 0.8 |
| 2-4 | 1 | 15.5 | | 4337.7 | | | | | |
| 2-6 | 5 | 22.1 | | 3.0 | 563.8 | 0.4 | | 32.3 | 0.01 |
| 2-11 | 3 | 28.1 | | 3.1 | | | | 90.0 | 284.5 |
| 2-12 | 1 | 18.2 | | 6.4 | | 63.8 | 1.0 | | 3.2 |
| 2-13 | 1 | 19.1 | | | | | 45.0 | | |
| 2-14 | 1 | 17.2 | | 2.5 | | | | | 34.8 |
| 2-7 | 1 | 25.3 | | | | | | | 252.5 |
| 2-8 | 1 | 32.4 | 115.1 | 33.4 | 47.4 | 12.2 | 52.8 | | |
| 2-15 | 1 | 13.7 | | 3.5 | | | 4.7 | | |
| 2-9 | 1 | 14.1 | | | | | 23.2 | | 23582.5 |

TABLE 7F

Antibody Panel ELISA Binding Titrations (EC50)

| ANTIBODY | EC50 (nM) |
|---|---|
| 2-8 | 0.08001 |
| 1-35 | 0.09604 |
| 1-3 | 0.133 |
| 2-5 | 0.1332 |
| 1-27 | 0.1479 |
| 1-31 | 0.2035 |
| 2-6 | 0.283 |
| 1-2 | 0.523 |
| 1-34 | 0.5584 |
| 2-2 | 0.612 |
| 1-67 | 0.9402 |
| 1-16 | 1.409 |
| 1-12 | 2.15 |
| 1-28 | 2.284 |
| 1-4 | 2.559 |
| 1-1 | 4.157 |
| 1-19 | 4.413 |
| 1-22 | 6.548 |
| 1-5 | 7.833 |
| 1-42 | 7.92 |
| 2-15 | 7.92 |
| 1-49 | 8.669 |
| 1-53 | 10.25 |
| 2-9 | 12.58 |
| 1-33 | 17.5 |
| 1-26 | 48.46 |
| 2-29 | 63.43 |
| 1-7 | 95.66 |
| 1-25 | 95.66 |
| 1-51 | 98.17 |
| 2-17 | 100 |
| 2-2 | 100 |

The data for ACE2 variant antibodies is seen in Tables 8A-8B.

TABLE 8A

ACE2 Variants Frequency and ELISA Data

| IgG | Freq. | ELISA (Avg) |
|---|---|---|
| 3-10 | 1 | 17.4 |
| 3-4 | 1 | 15.2 |
| 3-7 | 1 | 17.1 |
| 3-1 | 7 | 18.4 |
| 3-5 | 4 | 18.1 |
| 3-6 | 1 | 24.0 |
| 3-15 | 1 | 13.1 |
| 3-3 | 12 | 22.0 |
| 3-11 | 1 | 13.7 |
| 3-8 | 1 | 19.9 |
| 3-2 | 1 | 15.7 |
| 3-12 | 1 | 19.1 |
| 3-14 | 1 | 24.0 |
| 3-9 | 1 | 26.0 |
| 3-13 | 1 | 24.9 |
| 3-16 | 1 | 8.0 |
| 3-17 | 1 | 12.3 |
| 3-18 | 1 | 9.8 |
| 3-19 | 1 | 5.4 |
| 3-2 | 1 | 3.0 |
| 3-21 | 1 | 6.2 |
| 3-22 | 1 | 6.2 |
| 3-23 | 1 | 3.7 |

TABLE 8A-continued

ACE2 Variants Frequency and ELISA Data

| IgG | Freq. | ELISA (Avg) |
|---|---|---|
| 3-24 | 1 | 6.5 |
| 3-25 | 1 | 5.3 |
| 3-26 | 1 | 4.1 |
| 3-27 | 1 | 11.7 |
| 3-28 | 1 | 3.5 |
| 3-29 | 1 | 5.0 |

TABLE 8B

ACE2 Variants Frequency and ELISA Data

| IgG | Freq. | ELISA (Avg) |
|---|---|---|
| 4-51 | 1 | 52.0 |
| 4-52 | 1 | 49.3 |
| 4-53 | 1 | 41.1 |
| 4-54 | 1 | 40.7 |
| 4-49 | 21 | 35.1 |
| 4-55 | 1 | 29.0 |
| 4-39 | 1 | 28.0 |
| 4-56 | 1 | 22.9 |
| 4-33 | 1 | 20.2 |
| 4-57 | 1 | 19.6 |
| 4-25 | 1 | 17.0 |
| 4-58 | 1 | 15.1 |
| 4-69 | 2 | 21.8 |
| 4-18 | 4 | 20.4 |
| 4-63 | 2 | 24.7 |
| 4-73 | 2 | 20.2 |
| 4-43 | 2 | 22.9 |
| 4-72 | 2 | 20.6 |
| 4-5 | 2 | 26.6 |
| 4-67 | 4 | 20.0 |
| 4-41 | 2 | 33.9 |
| 4-6 | 2 | 22.9 |
| 4-16 | 2 | 38.7 |
| 4-32 | 2 | 21.2 |
| 4-75 | 2 | 37.5 |
| 4-37 | 2 | 24.1 |
| 4-15 | 2 | 35.4 |
| 4-42 | 2 | 35.9 |
| 4-17 | 2 | 28.1 |
| 4-35 | 2 | 26.4 |
| 4-20 | 2 | 31.0 |
| 4-31 | 18 | 24.8 |
| 4-14 | 4 | 30.3 |
| 4-7 | 2 | 35.4 |
| 4-76 | 2 | 23.1 |
| 4-89 | 2 | 39.4 |
| 4-64 | 4 | 23.7 |
| 4-3 | 2 | 41.6 |
| 4-45 | 2 | 37.8 |
| 4-6 | 2 | 27.8 |
| 4-11 | 2 | 25.1 |
| 4-44 | 2 | 23.3 |
| 4-82 | 2 | 27.1 |
| 4-40 | 2 | 25.3 |
| 4-62 | 2 | 27.7 |
| 4-74 | 2 | 25.4 |
| 4-78 | 2 | 21.1 |
| 4-46 | 2 | 25.3 |
| 4-2 | 2 | 25.7 |
| 4-21 | 2 | 22.6 |
| 4-9 | 2 | 24.2 |
| 4-61 | 2 | 25.1 |
| 4-12 | 2 | 21.8 |
| 4-29 | 2 | 22.0 |
| 4-34 | 2 | 25.4 |
| 4-47 | 2 | 20.9 |
| 4-95 | 2 | 23.2 |
| 4-36 | 2 | 20.1 |
| 4-98 | 1 | 9.1 |
| 4-99 | 1 | 4.8 |

TABLE 8B-continued

ACE2 Variants Frequency and ELISA Data

| IgG | Freq. | ELISA (Avg) |
|---|---|---|
| 4-1 | 1 | 6.5 |
| 4-101 | 1 | 17.4 |
| 4-102 | 1 | 14.4 |
| 4-103 | 1 | 9.0 |
| 4-104 | 1 | 5.3 |
| 4-105 | 1 | 7.8 |
| 4-106 | 1 | 5.4 |
| 4-107 | 1 | 7.5 |
| 4-108 | 1 | 10.0 |
| 4-109 | 1 | 17.5 |
| 4-11 | 1 | 23.3 |
| 4-111 | 1 | 14.0 |
| 4-112 | 1 | 11.1 |
| 4-113 | 1 | 8.9 |
| 4-114 | 1 | 9.9 |
| 4-115 | 1 | 26.4 |
| 4-116 | 1 | 12.6 |
| 4-117 | 1 | 12.4 |
| 4-118 | 1 | 34.9 |
| 4-119 | 1 | 28.6 |
| 4-12 | 1 | 17.9 |
| 4-121 | 1 | 36.2 |
| 4-122 | 1 | 10.6 |
| 4-123 | 1 | 14.2 |
| 4-124 | 1 | 29.3 |
| 4-125 | 1 | 22.2 |
| 4-126 | 1 | 14.6 |
| 4-127 | 1 | 16.1 |
| 4-128 | 1 | 5.3 |
| 4-129 | 1 | 6.8 |
| 4-13 | 1 | 23.1 |
| 4-131 | 1 | 37.9 |
| 4-132 | 1 | 10.9 |
| 4-134 | 1 | 14.7 |
| 4-135 | 1 | 7.3 |
| 4-136 | 1 | 16.3 |
| 4-137 | 1 | 4.8 |
| 4-138 | 1 | 21.3 |
| 4-139 | 1 | 34.3 |
| 4-14 | 1 | 43.7 |
| 4-141 | 1 | 15.0 |
| 4-142 | 1 | 14.4 |
| 4-143 | 1 | 8.4 |
| 4-144 | 1 | 11.8 |
| 4-145 | 1 | 9.5 |
| 4-146 | 1 | 7.8 |
| 4-147 | 1 | 6.4 |
| 4-148 | 1 | 20.6 |
| 4-149 | 1 | 14.3 |
| 4-15 | 1 | 22.3 |
| 4-151 | 1 | 15.1 |

VERO C1008 [Vero 76, clone E6, Vero E6] (ATCC® CRL-1586™) are derived from the kidney of an African green monkey and are commonly used mammalian continuous cell lines. These cells are known to express ACE2 and have been used for SARS-CoV-2 neutralization assays. To assess the binding efficiency of this panel of antibodies, each antibody was incubated with $10^5$ VERO E6 cells at 100 nM, a labeled secondary antibody was used to measure binding using flow cytometry. The binding of each antibody was compared to a baseline value, consisting of secondary antibody alone, to derive a Mean Fluorescence Intensity (MFI) over baseline (MFI/Baseline). Data for antibody variant 4-23 is seen in FIG. 14. Data for variant 3-1 is seen in FIG. 15A.

The entire panel shows varying degrees of specific binding to VERO E6 cells as in Tables 9A-9B. S1 Fc fusion protein and S1 RBD Fc fusion (expressed in-house) were added as positive controls for ACE2 binding.

TABLE 9A

ACE2 Variant Binding

| Antibody | MFI | MFI/Baseline |
|---|---|---|
| 4-15 | 40911 | 103.1 |
| 4-101 | 30450 | 76.7 |
| 4-3 | 23871 | 73.7 |
| 4-44 | 23486 | 72.5 |
| 4-89 | 22369 | 69.0 |
| 4-142 | 25078 | 63.2 |
| 4-12 | 24964 | 62.9 |
| 4-148 | 23582.5 | 59.4 |
| 4-75 | 18861 | 58.2 |
| 4-52 | 18184 | 56.1 |
| 4-50 | 17964 | 55.4 |
| 4-25 | 17603 | 54.3 |
| 4-138 | 21564 | 54.3 |
| 4-35 | 17460 | 53.9 |
| 4-39 | 17390 | 53.7 |
| 4-49 | 17249 | 53.2 |
| 4-119 | 21061.5 | 53.1 |
| 4-137 | 20784.5 | 52.4 |
| 4-64 | 16834 | 52.0 |
| 4-37 | 15775 | 48.7 |
| 4-21 | 15024 | 46.4 |
| 4-68 | 14963 | 46.2 |
| 4-97 | 14963 | 46.2 |
| 4-11 | 14782 | 45.6 |
| 4-85 | 14194 | 43.8 |

TABLE 9B

ACE2 Variant Binding

| Antibody | MFI | MFI/Baseline |
|---|---|---|
| 4-67 | 13852 | 42.8 |
| 4-144 | 16698 | 42.1 |
| 4-63 | 13247 | 40.9 |
| 4-114 | 15946.5 | 40.2 |
| 4-47 | 12720 | 39.3 |
| 4-17 | 12720 | 39.3 |
| 4-43 | 12413 | 38.3 |
| 4-9 | 12115 | 37.4 |
| 4-28 | 11968 | 36.9 |
| 4-32 | 11823 | 36.5 |
| 4-4 | 11538 | 35.6 |
| 4-29 | 11492 | 35.5 |
| 4-3 | 11352 | 35.0 |
| 4-73 | 10989 | 33.9 |
| 4-62 | 10856 | 33.5 |
| 4-54 | 10812 | 33.4 |
| 4-16 | 10812 | 33.4 |
| 4-69 | 10509 | 32.4 |
| 4-77 | 10382 | 32.0 |
| 4-14 | 9928 | 30.6 |
| 4-53 | 9117 | 26.5 |
| 4-121 | 4882 | 12.3 |
| 4-14 | 2876 | 7.2 |
| S1 Fc Fusion | 55333 | 160.9 |
| S1 RBD Fc | 26102 | 75.9 |

TABLE 10A

ACE2 Variant Quality

| Antibody | MFI | MFI/Baseline |
|---|---|---|
| 3-10 | 170440 | 495.5 |
| 4-15 | 40911 | 103.1 |
| 4-6 | 29246 | 90.3 |
| 4-101 | 30450 | 76.7 |
| 4-3 | 23871 | 73.7 |
| 4-44 | 23486 | 72.5 |
| 4-61 | 22921 | 70.7 |
| 4-89 | 22369 | 69.0 |
| 4-65 | 21742 | 67.1 |
| 4-142 | 25078 | 63.2 |
| 4-12 | 24964 | 62.9 |
| 4-148 | 23582.5 | 59.4 |
| 4-75 | 18861 | 58.2 |
| 4-52 | 18184 | 56.1 |
| 4-50 | 17964 | 55.4 |
| 4-25 | 17603 | 54.3 |
| 4-138 | 21564 | 54.3 |
| 4-35 | 17460 | 53.9 |
| 4-39 | 17390 | 53.7 |
| 4-49 | 17249 | 53.2 |
| 4-119 | 21061.5 | 53.1 |
| 4-137 | 20784.5 | 52.4 |
| 4-64 | 16834 | 52.0 |
| 4-37 | 15775 | 48.7 |
| 4-21 | 15024 | 46.4 |

TABLE 10B

ACE2 Variant Quality

| Antibody | MFI | MFI/Baseline |
|---|---|---|
| 4-68 | 14963 | 46.2 |
| 4-97 | 14963 | 46.2 |
| 4-11 | 14782 | 45.6 |
| 3-13 | 15647 | 45.5 |
| 4-85 | 14194 | 43.8 |
| 4-67 | 13852 | 42.8 |
| 4-144 | 16698 | 42.1 |
| 4-63 | 13247 | 40.9 |
| 4-43 | 12413 | 38.3 |
| 4-114 | 15946.5 | 40.2 |
| 4-47 | 12720 | 39.3 |
| 4-17 | 12720 | 39.3 |
| 4-54 | 10812 | 33.4 |
| 3-4 | 11261 | 32.7 |
| 3-2 | 10132 | 29.5 |
| 3-7 | 9117 | 26.5 |
| 3-15 | 8440 | 24.5 |
| 3-3 | 7174 | 20.9 |
| 4-121 | 4882 | 12.3 |
| 3-5 | 4030 | 11.7 |
| 3-6 | 3746 | 10.9 |
| 4-14 | 2876 | 7.2 |
| 4-118 | 1091.5 | 2.7 |
| S1 Fc Fusion | 55333 | 160.9 |
| S1 RBD Fc Fusion | 26102 | 75.9 |

Figure 15B:
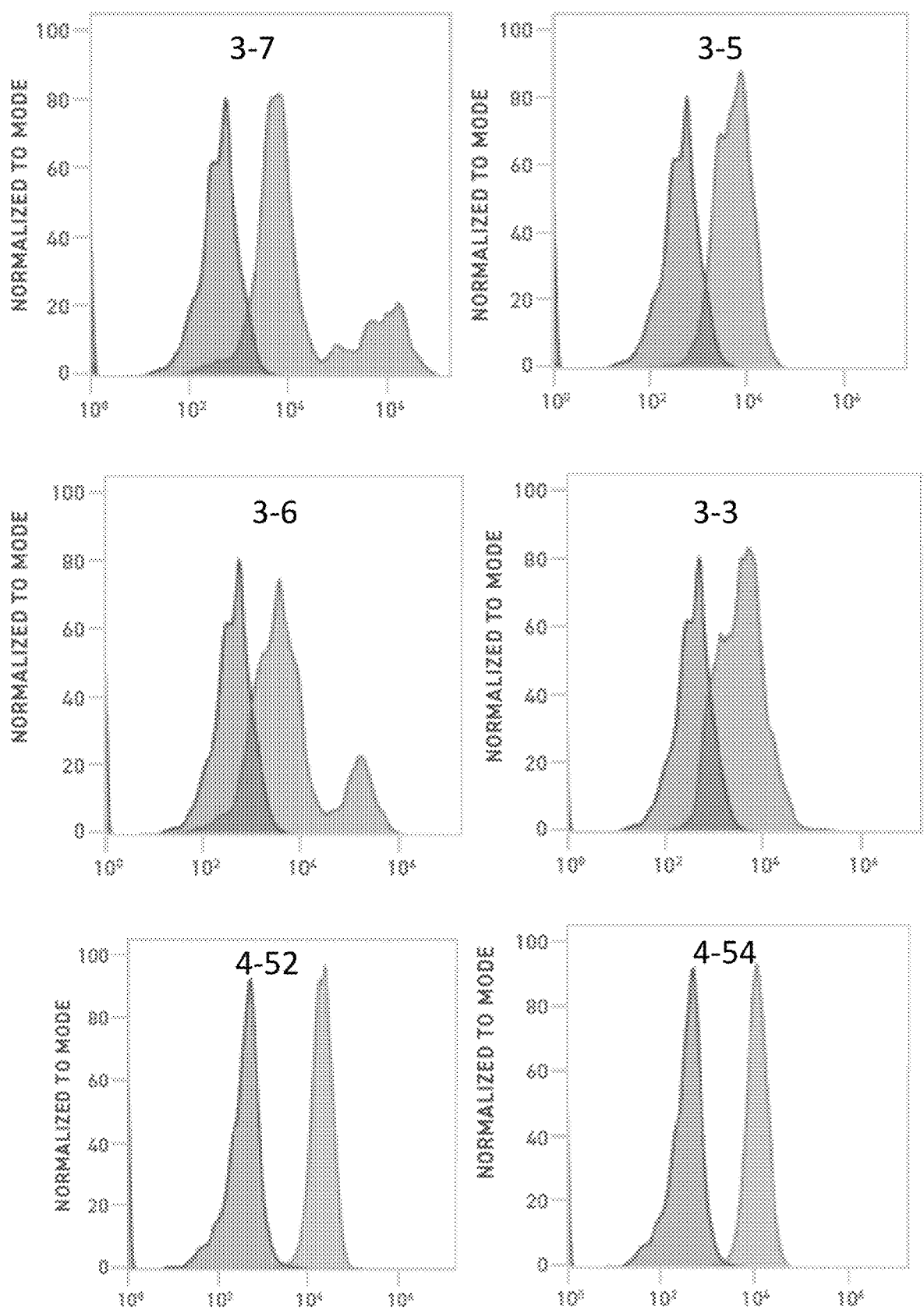
Figure 15C:
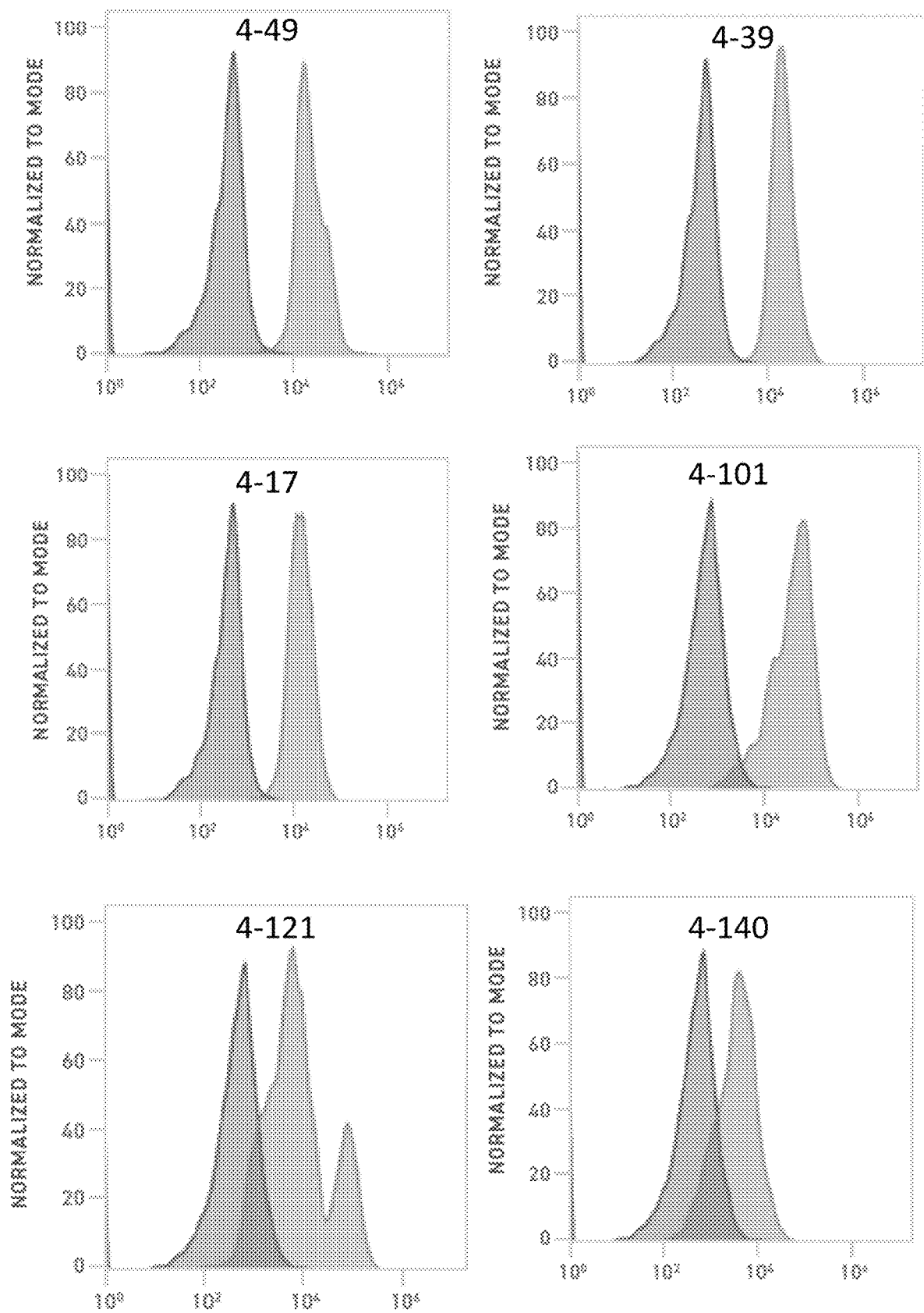
Figure 15D:
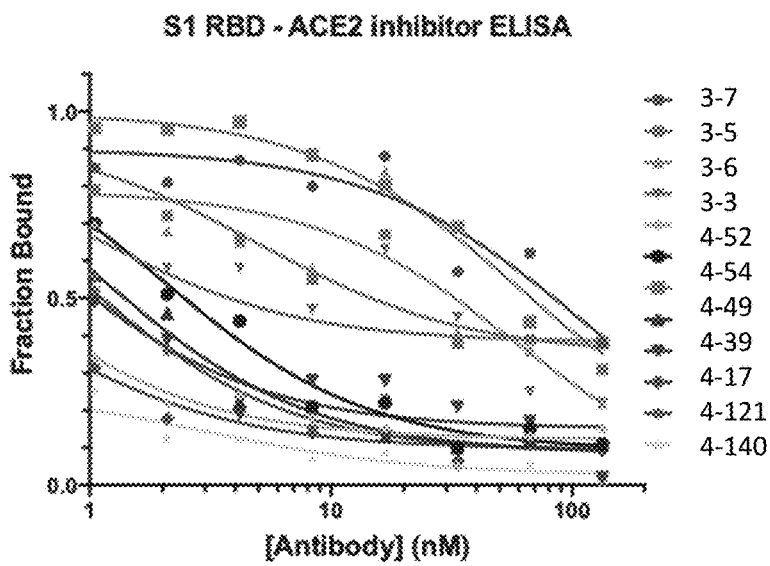
FIG. 15D is a graph of data from S1 RBD ACE2 inhibitor ELISA.

Purified antibodies were quantified by Unchained Lunatic and analyzed by Perkin Elmer LabChip System, CE-SDS (R, purity) for quality control. Data is seen in FIGS. 15B-15Ds Tables 10A-10D. Table 10D shows kinetic data for the variant antibodies collected using the Carterra LSA instrument (Fc, Fc-capture; DC, Direct-capture). The variant antibodies exhibit very high specificity and affinity to their antigen targets with affinities in the picomolar to nanomolar range.

TABLE 10C

| Ab | IC50 (nM) |
|---|---|
| 3-7 | 101.1 |
| 3-5 | 4.929 |
| 3-6 | 60.02 |
| 3-3 | 0.9157 |
| 4-52 | 0.3499 |

TABLE 10C-continued

| Ab | IC50 (nM) |
|---|---|
| 4-54 | 1.995 |
| 4-49 | 58.01 |
| 4-39 | 1.148 |
| 4-17 | 0.7208 |
| 4-101 | 0.5675 |
| 4-121 | 0.9101 |
| 4-140 | 3.07 |

TABLE 10D

| Antibody | $K_D$, ACE2 Fc | $K_D$, ACE2 DC |
|---|---|---|
| 3-7 | 3.4 | 32.6 |
| 3-5 | 6.7 | >1000 |
| 3-6 | 5.6 | >1 |
| 3-3 | 7.3 | NA |
| 4-52 | 11.5 | 557.1 |
| 4-54 | NA | 644.8 |
| 4-49 | 0.3 | 228.6 |
| 4-39 | 17.5 | NA |
| 4-17 | 18.8 | 30.6 |
| 4-101 | NA | 5.8 |
| 4-118 | NA | NA |
| 4-121 | NA | NA |
| 4-140 | NA | 8.9 |

The SARS-CoV-2 and ACE2 variant antibodies were also assayed for affinity (data not shown). As a negative control, Trastuzumab was found not to bind to ACE2.

Figure 16A:
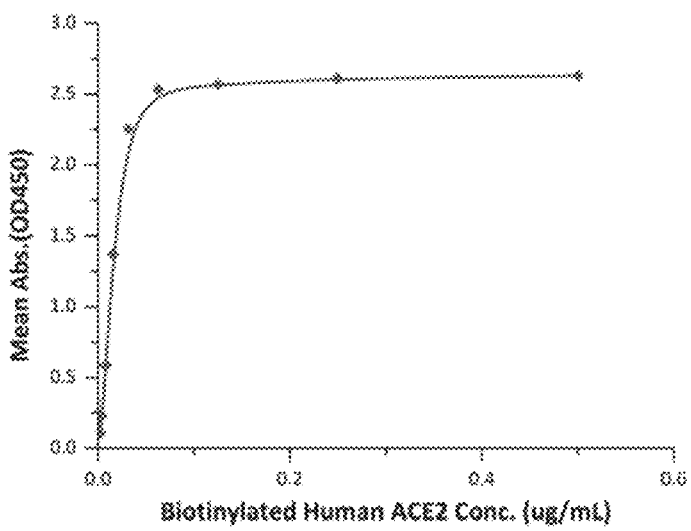
FIG. 16A-16B are graphs of SARS-CoV-2 and ACE2 competition ELISAs.
Figure 16B:
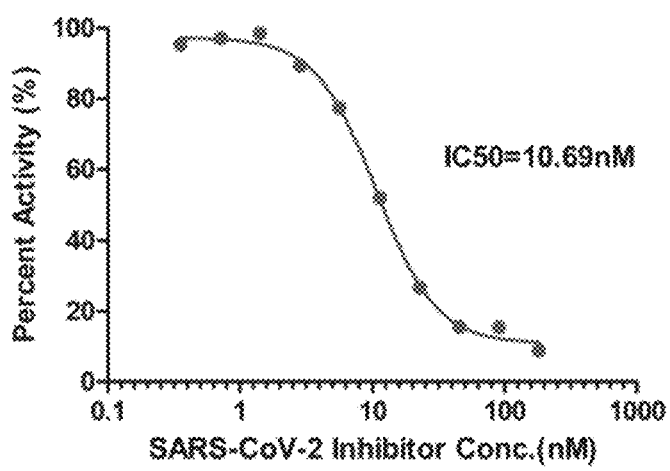
Figure 17A:
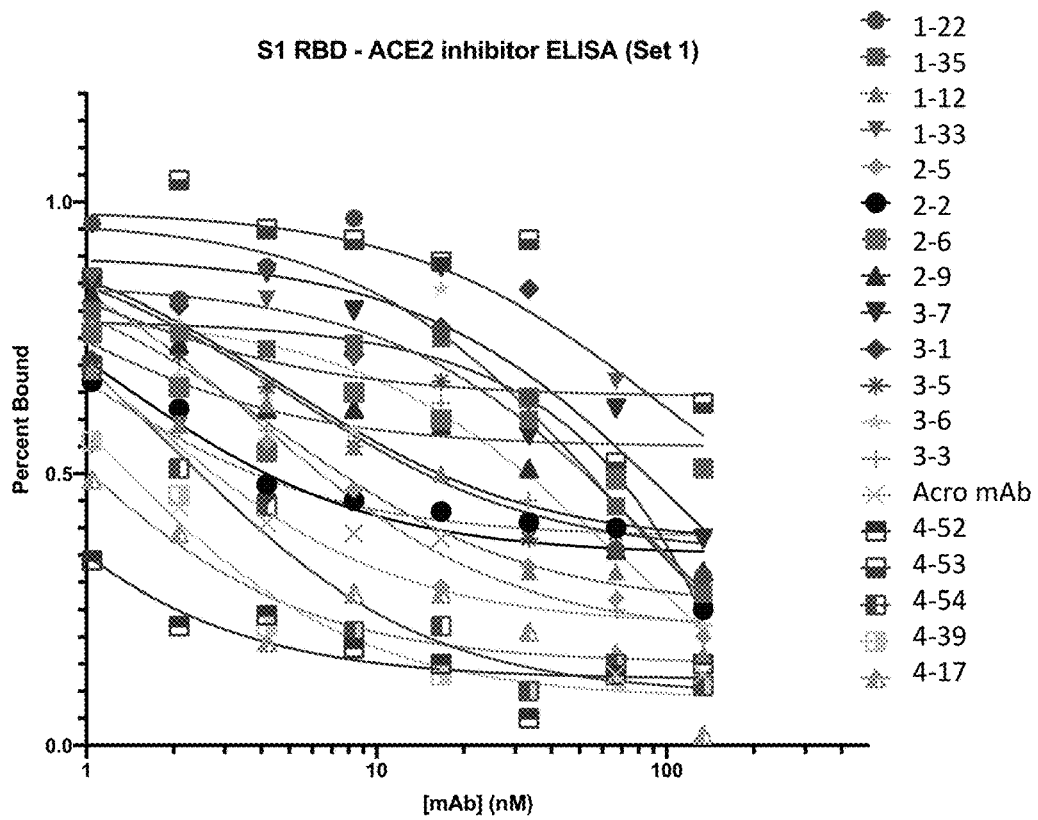
FIG. 17A is a graph of SARS-CoV-2 and ACE2 competition ELISAs from a first set.
Figure 17B:
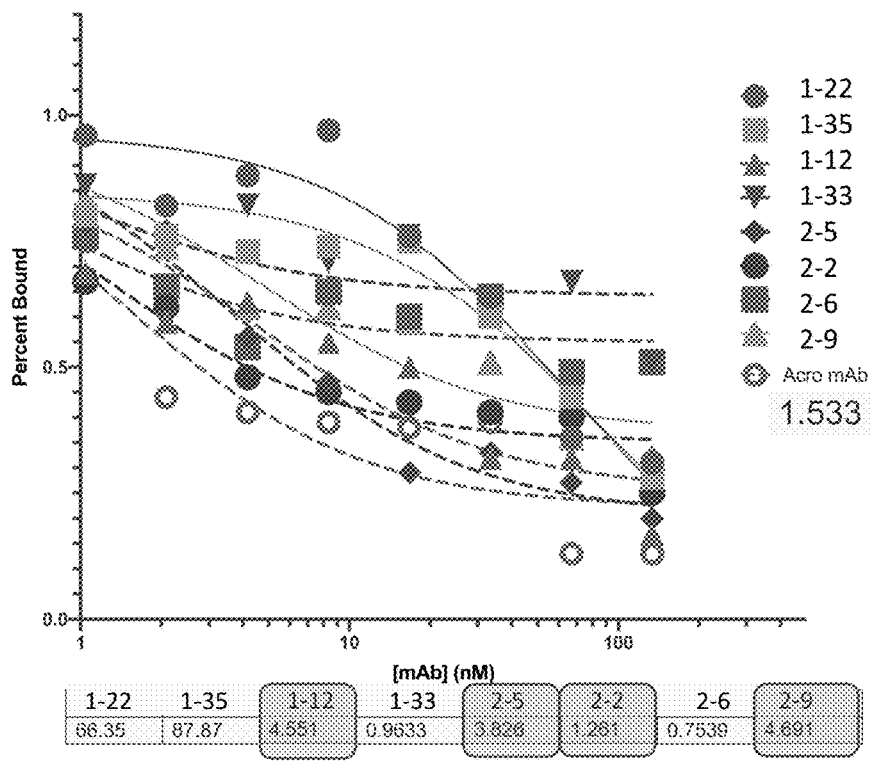
FIG. 17B is a graph of SARS-CoV-2 and ACE2 competition ELISAs from a first set showing SARS-CoV-2 variant antibodies.
Figure 18A:
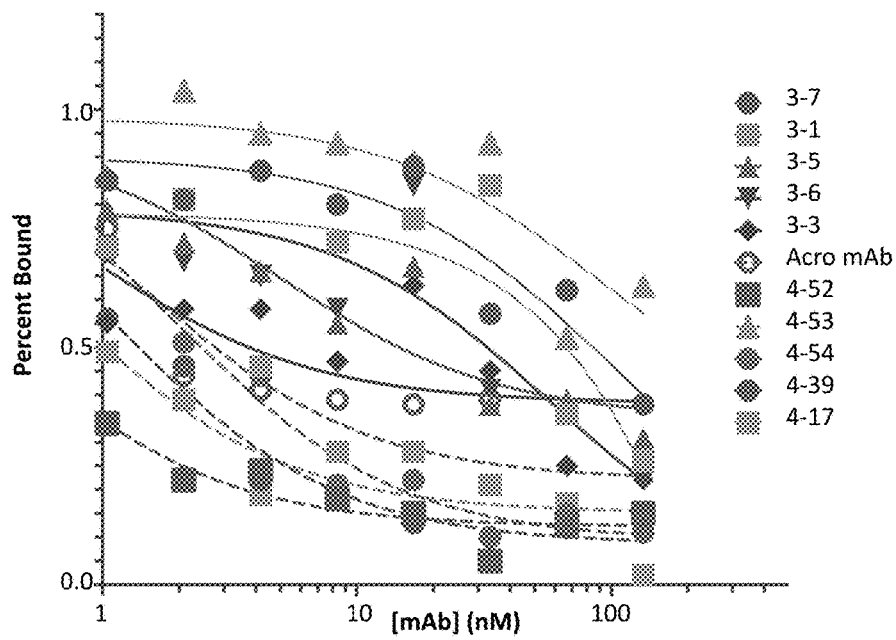
FIGS. 18A-18B are graphs from a first set (FIG. 18A) and second set (FIG. 18B) showing ACE2 variant antibodies.
Figure 18B:
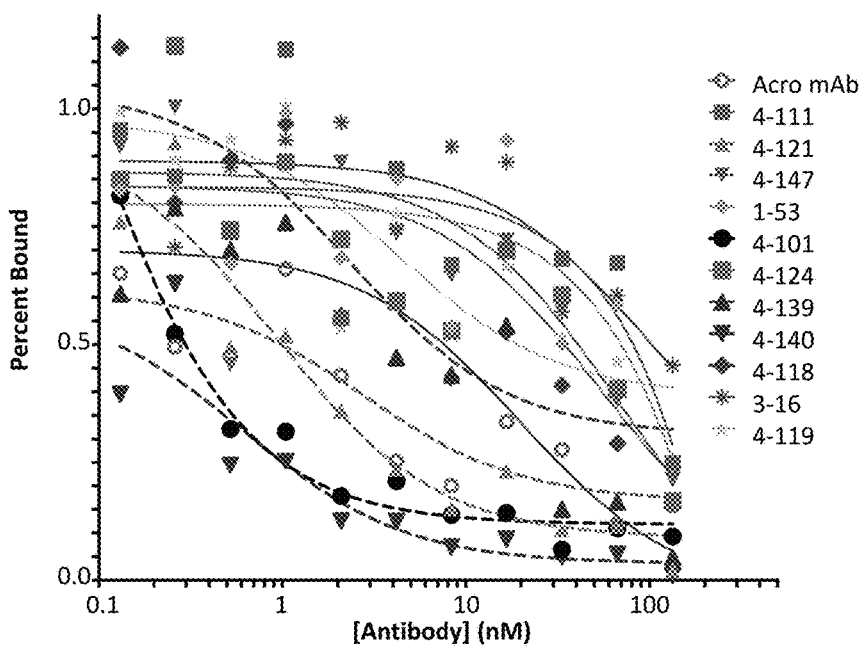
Figure 18C:
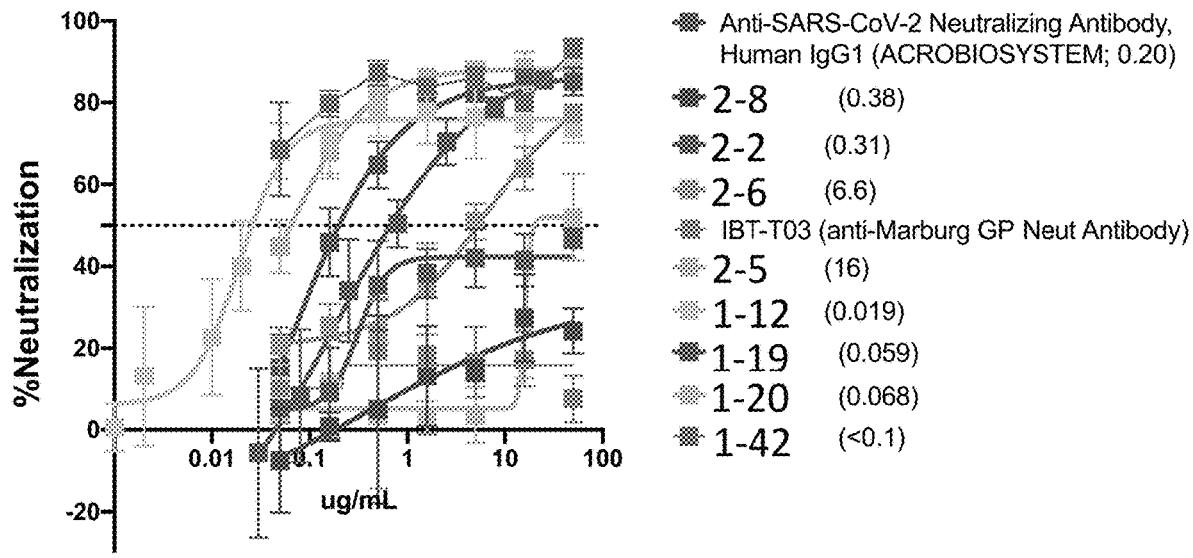
FIGS. 18C-18D are graphs of SARS-CoV-2 variant antibodies in neutralization assays.
Figure 18D:
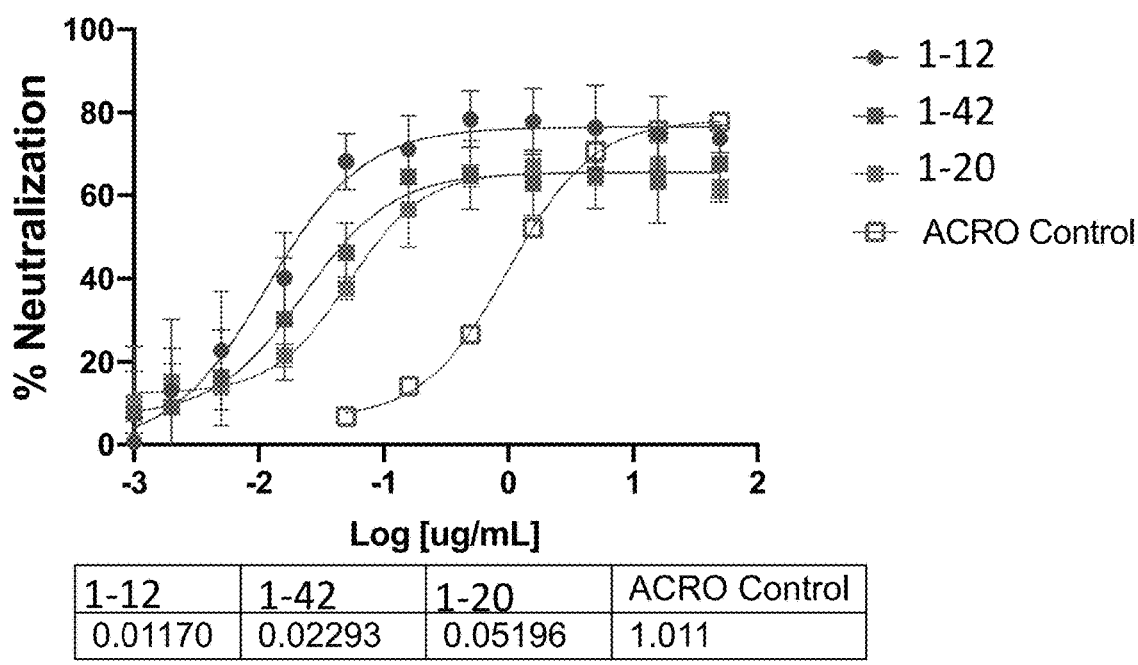

Competition ELISAs were performed on the variant antibodies. Typical data for SARS-CoV-2 S1 RBD and ACE2 competition ELISA is seen in FIGS. 16A-16B. Data for competition ELISA for a first set of SARS-CoV-2 S1 RBD and ACE2 variant antibodies is seen in FIGS. 17A-17B and FIG. 18A. SARS-CoV-2 variant antibodies with high potency in order of potency included variant 2-2, Acro mAb (1.5333), variant 2-5, variant 1-12, and variant 2-9. ACE variant antibodies with high potency in order of potency included variant 4-52, variant 4-17, variant 4-39, Acro mAb (1.533), variant 4-54, and variant 3.5. Data for competition ELISA for a second set of ACE2 variant antibodies is seen in FIG. 18B. Variant antibodies with high potency in order of potency included variant 4-101, variant 4-140, variant 4-121, variant 4-118, and Acro mAb (2.76 nM). FIGS. 18C-18D show the SARS-CoV-2 variant antibodies show potent neutralization.

Figure 19:
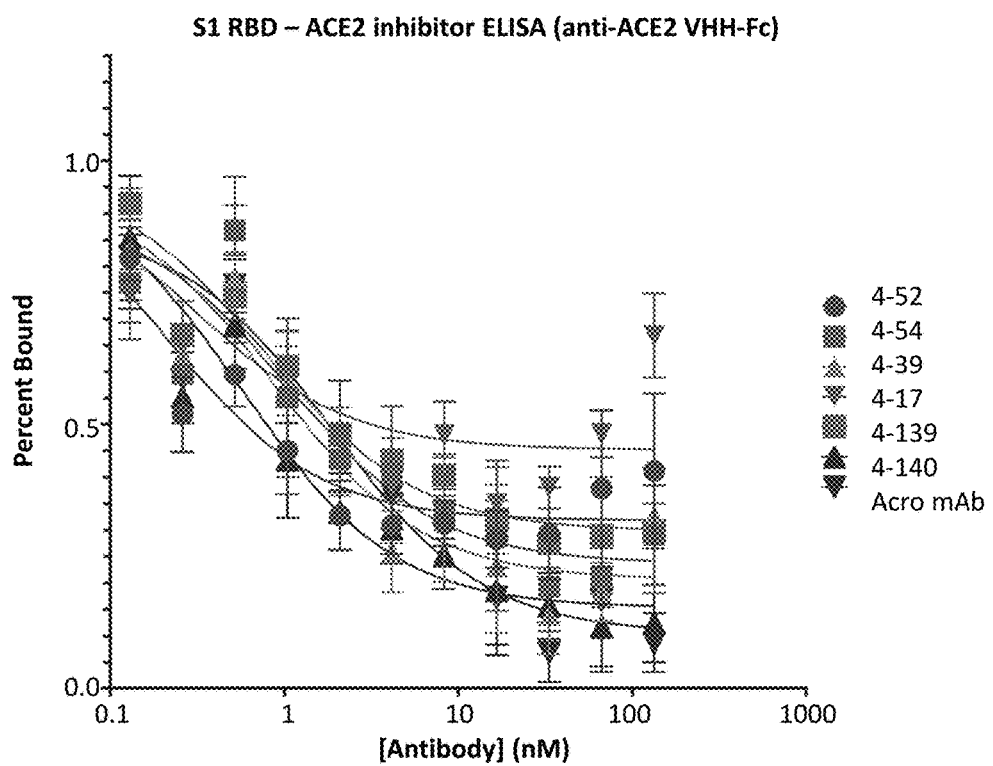
FIG. 19 is a graph of anti-ACE2 inhibitors.
Figure 20:
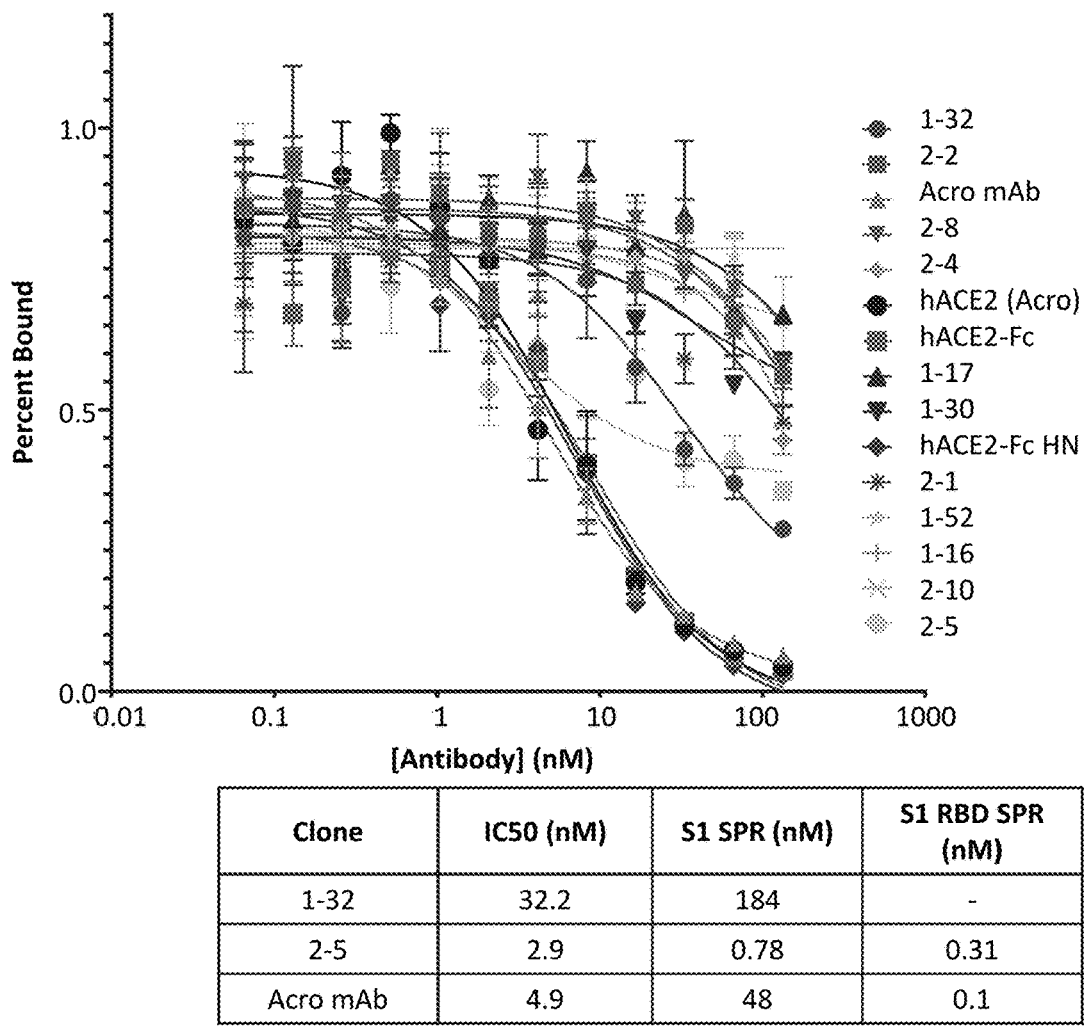
FIG. 20 is a graph of SARS-CoV-2 and ACE2 inhibition.
Figure 21A:
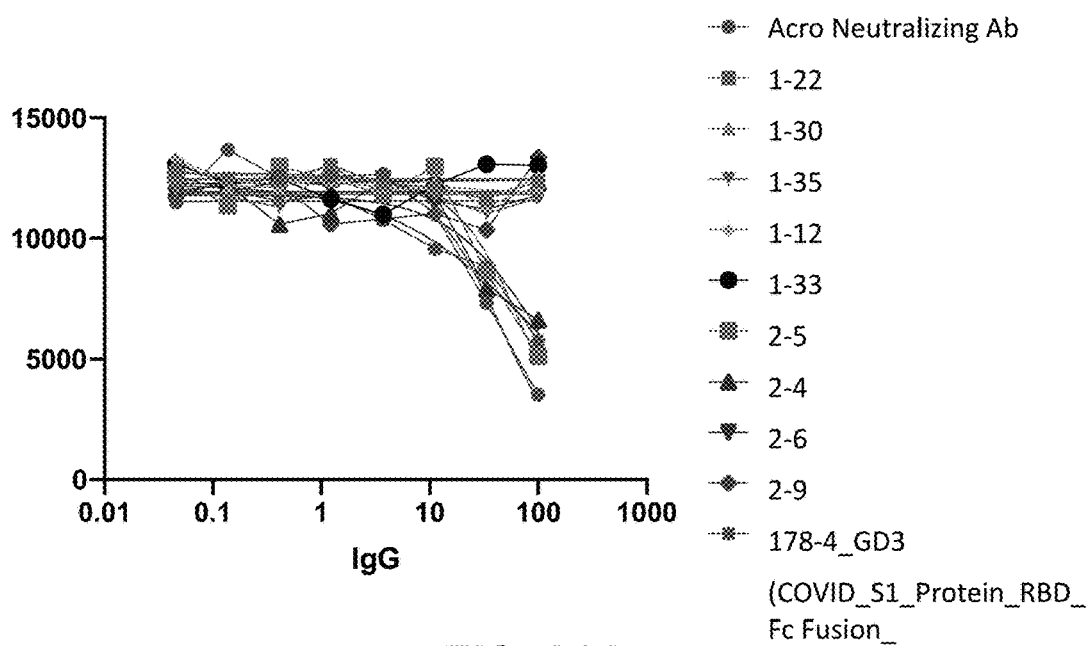
FIGS. 21A-21D are graphs of SARS-CoV-2 variant antibodies on VERO E6 inhibition measured by FACS.
Figure 21B:
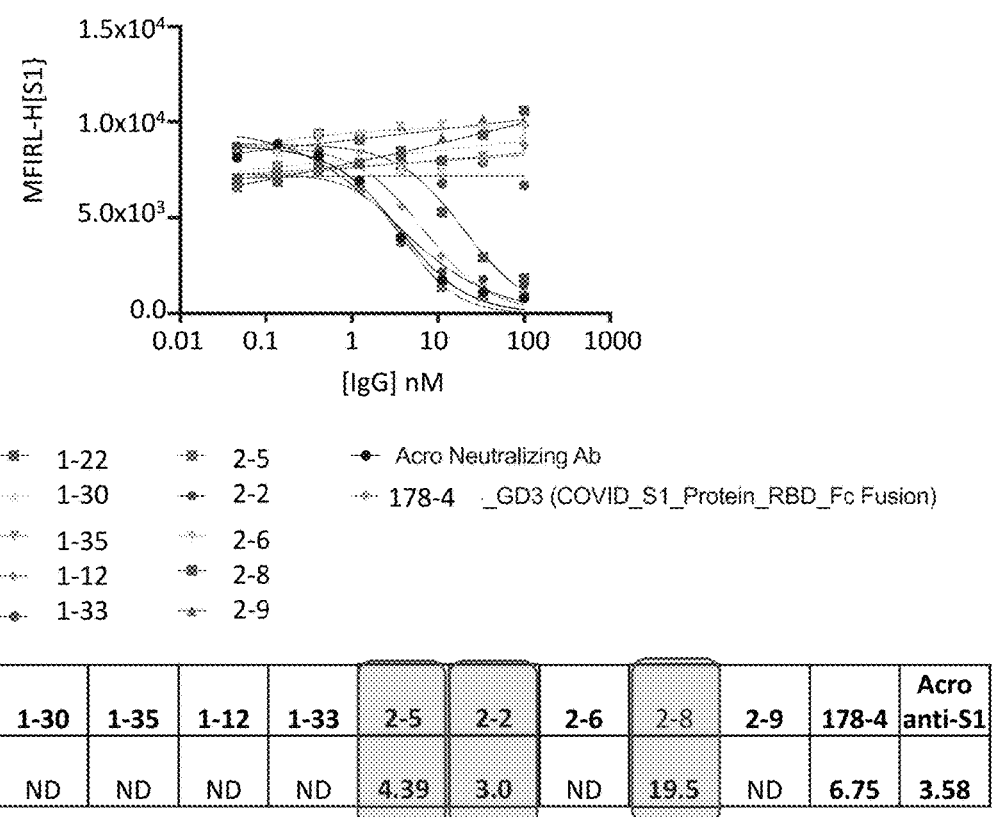
Figure 21C:
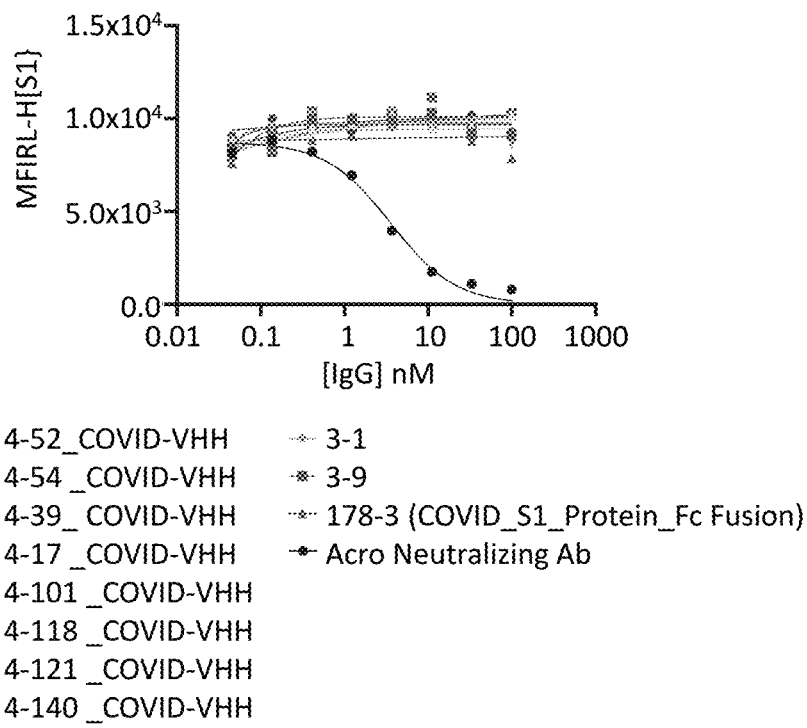
Figure 21D:
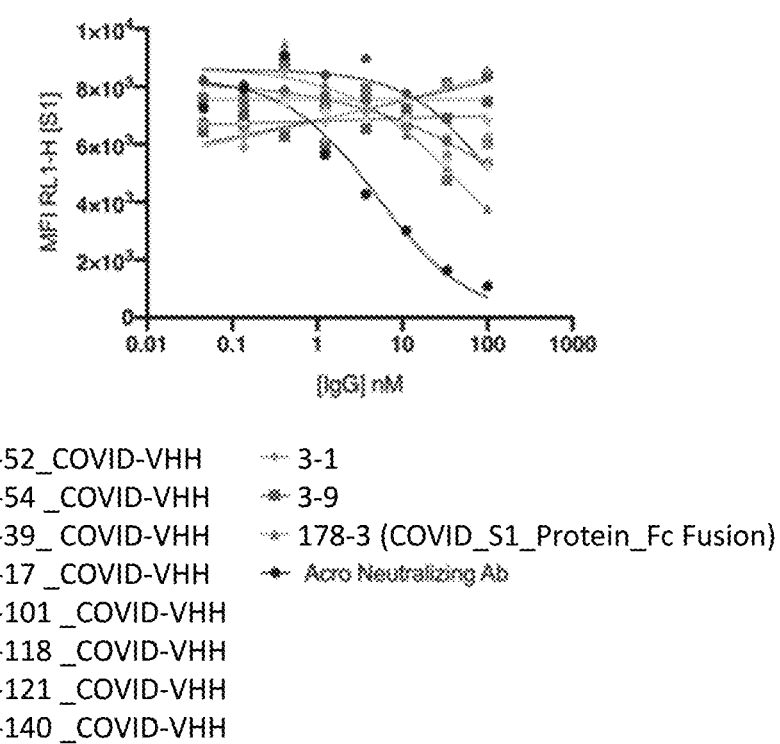
Figure 22A:
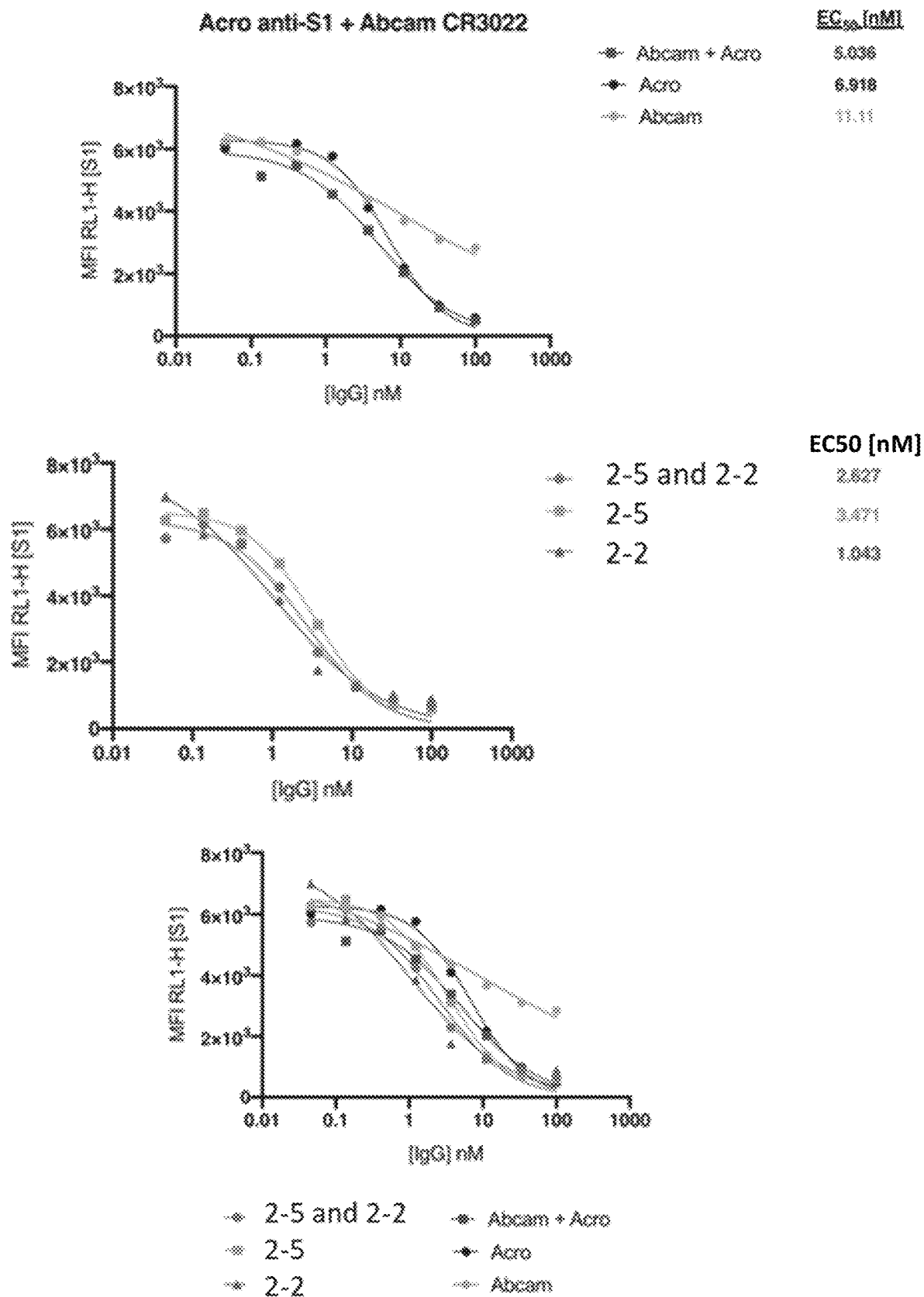
FIGS. 22A-22B are graphs of SARS-CoV-2 variant antibodies on VERO E6 inhibition measured by FACS as compared to CR3022.
Figure 22B:
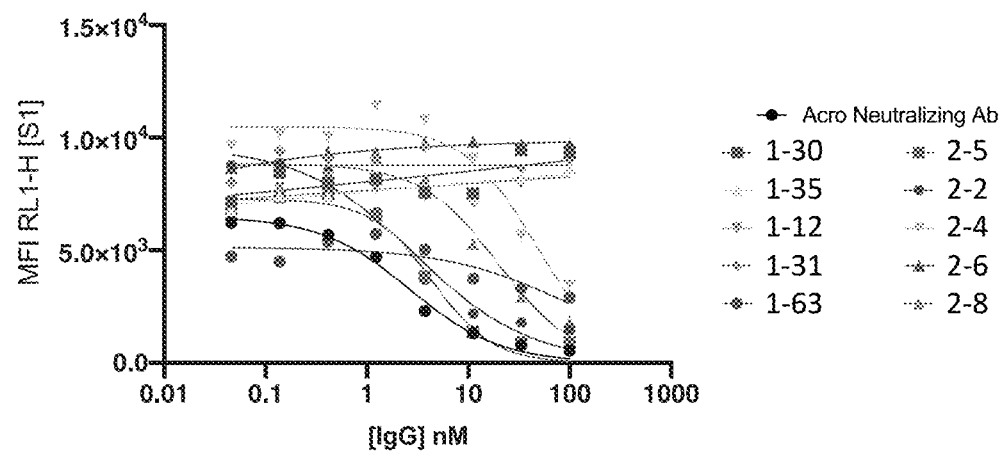
Figure 22C:
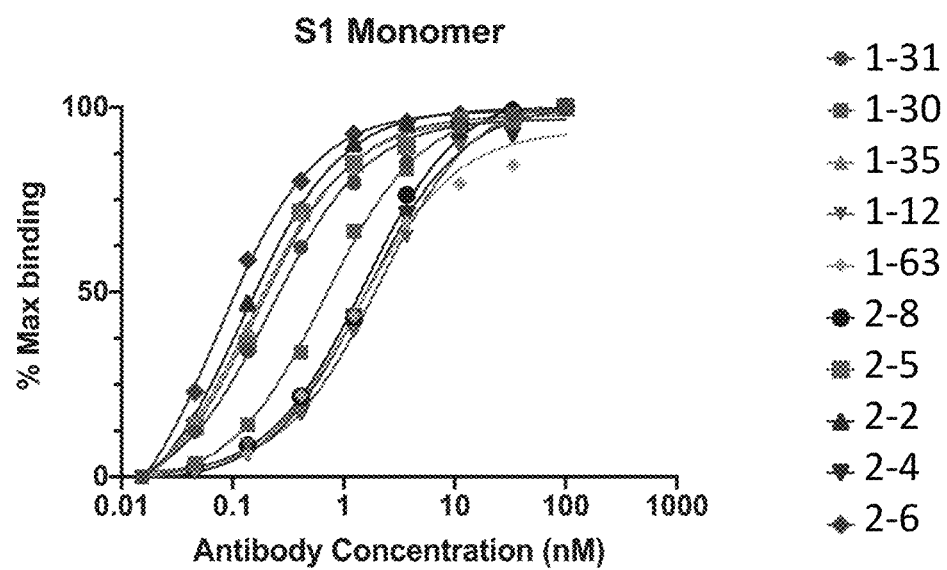
FIGS. 22C-22D are graphs of affinity of SARS-CoV-2 variant antibodies determined by coating ELISA plates with SARS-CoV-2 Spike Glycoprotein S1 (FIG. 22C) or S protein trimer (FIG. 22D).
Figure 22D:
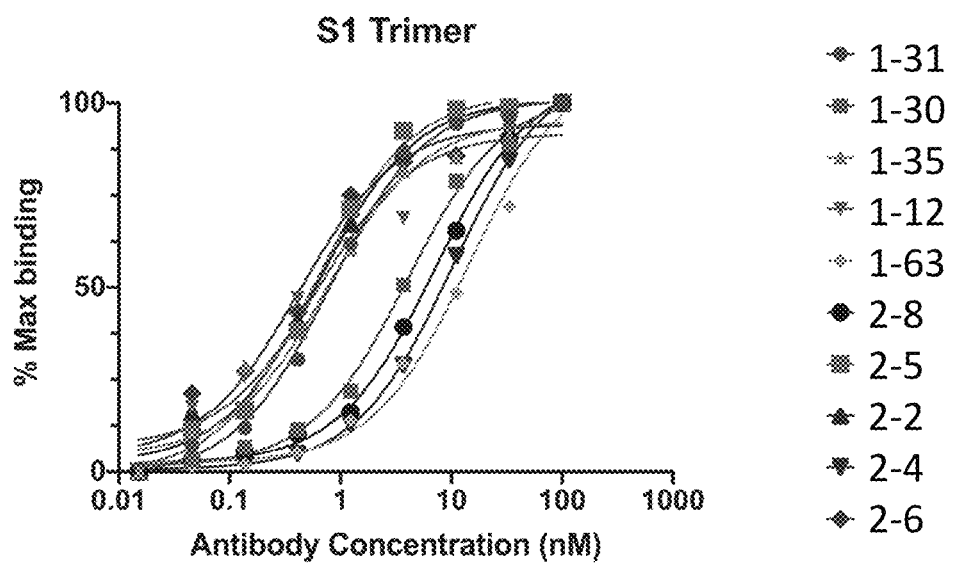
Figure 22E:
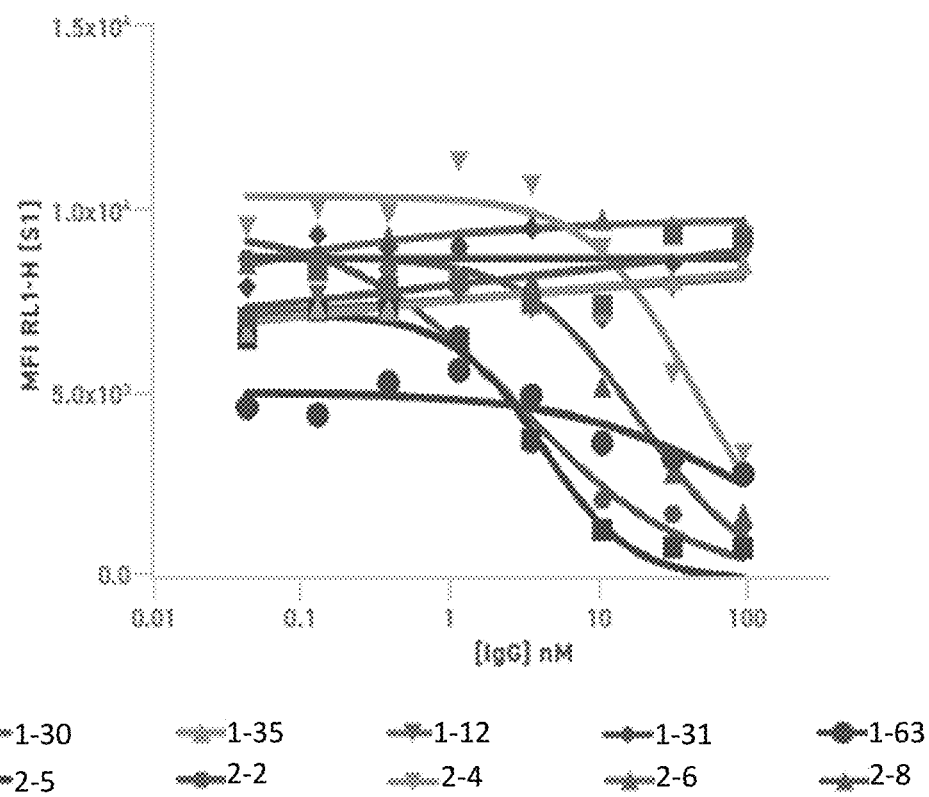
FIG. 22E is a graph of mean fluorescent intensity (MFI) plotted for each SARS-CoV-2 variant antibody dilution.
Figure 23:
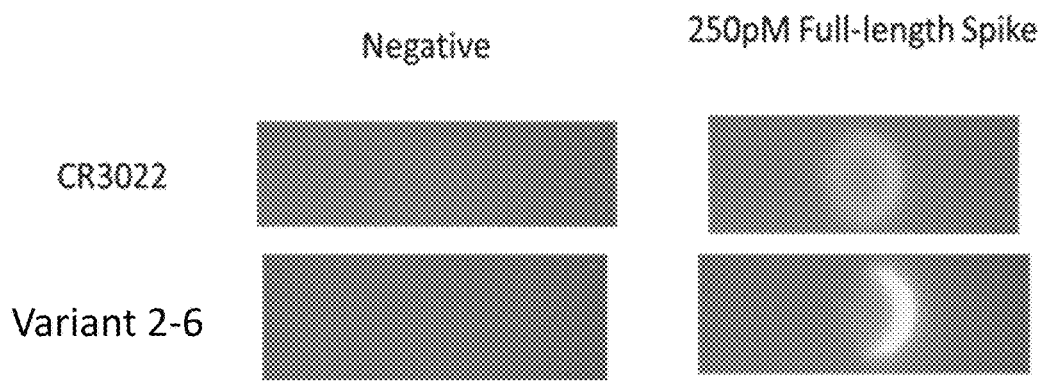
FIG. 23 are images from bluDiagnostics assay of CR3022 and variant 2-6.

Anti-ACE2 inhibitors were also identified using ELISA as seen in FIG. 19. Variant antibodies with high potency in order of potency included variant 4-52, variant 4-17, variant 4-14, variant 4-139, variant 4-39, variant 4-54, and Acro mAb (1.887 nM). Inhibition assays were also performed as seen in FIG. 20.

SARS-CoV-2 variant antibodies were assayed for Vero inhibition using FACS. Briefly, Vero cells stripped with Cell Stripper (~20 minutes with 90% viability after removal). Cells were plated at $0.1 \times 10^6$ cells per well. Stock solution of the variant antibodies were at 200 nM titrated 1:3. SARS-CoV-2 S protein RBD, SPD-C5259 were made up at 6 ug/mL. Variant antibody titrations were mixed 1:1 with 6 ug/mL S protein (50 uL IgG: 50 uL S protein). 100 uL of the mixture were added to cells and then incubated on ice for 1 hour. The cells were washed 1× followed by addition of 50 uL of goat anti-mouse secondary made up at 1:200. The cells were then incubated on ice for 1 hour in the dark, washed three times, and the plates were then read. Data for SARS-CoV-2 variant antibodies is seen in FIGS. 21A-21D, FIGS. 22A-22E, and Tables 10E-10F. As seen in the data, several variant antibodies blocked labeled S1 RBD from binding to ACE2 on the Vero cells including variants 2-8, 2-5, 2-2, 2-4, and 1-63.

TABLE 10E

| Antibody | IC50 (nM) |
|---|---|
| Acro Anti-S1 | 2.7 |
| 1-30 | NC |
| 1-35 | NC |
| 1-12 | NC |
| 1-31 | NC |
| 1-63 | 106.6 |
| 2-5 | 4.4 |
| 2-2 | 3.0 |
| 2-4 | 46.3 |
| 2-6 | NC |
| 2-8 | 19.5 |

TABLE 10F

| | S1 Monomer (nM) | S Trimer (nM) |
|---|---|---|
| 1-31 | 0.22 | 0.80 |
| 1-30 | 0.67 | 4.02 |
| 1-35 | 0.15 | 0.76 |
| 1-12 | 2.08 | 0.61 |
| 1-63 | 1.40 | 14.39 |
| 2-8 | 1.52 | 7.08 |
| 2-5 | 0.17 | 0.59 |
| 2-2 | 0.13 | 0.64 |
| 2-4 | 1.58 | 10.18 |
| 2-6 | 0.07 | 0.43 |

A summary of epitope binning for SARS-CoV-2 variant antibodies is seen in Table 10G below.

TABLE 10G

SARS-CoV-2 Epitope Binning

| ID | Acro mAb | 2-2 | Abeam CR3022 | 2-5 | 2-8 | 2-11 | 1-32 | 1-16 | 2-6 | 1-35 |
|---|---|---|---|---|---|---|---|---|---|---|
| *Acro mAb | 0 | 0 | 2 | 1 | 1 | 1 | 1 | 1 | 1 | 1 |
| *2-2 | 0 | 0 | 0 | 0 | 0 | 0 | 2 | 0 | 2 | 1 |
| Abeam CR3022 | 2 | 0 | 0 | 0 | 0 | 1 | 1 | 2 | 2 | 2 |
| *2-5 | 1 | 0 | 0 | 0 | 0 | 1 | 1 | 1 | 1 | 1 |
| *2-8 | 1 | 0 | 0 | 0 | 0 | 1 | 1 | 1 | 1 | 1 |
| 2-11 | 1 | 0 | 0 | 0 | 0 | 0 | 1 | 2 | 1 | 1 |
| **1-32 | 2 | 1 | 3 | 1 | 2 | 1 | 0 | 0 | 1 | 1 |
| 1-16 | 1 | 1 | 2 | 2 | 1 | 1 | 1 | 0 | 0 | 0 |
| 2-6 | 2 | 2 | 3 | 2 | 2 | 2 | 1 | 0 | 0 | 0 |
| 1-35 | 1 | 1 | 2 | 2 | 1 | 1 | 1 | 0 | 0 | 0 |

*Anti-S1 inhibiting IgG in FACS (Vero E6)
**Anti-S1 inhibiting IgG in ELISA (soluble ACE2)

The variant antibodies were also measured in binding against other coronaviruses. Data shows that the variant antibodies do not bind significantly to S1 HCoV-229E (Sino), S1 HCoV-HKU1 (Sino), S1 HCoV-NL63 (Sino), or S1 HCoV-OC43 (Sino) (data not shown).

BluDiagnostics initial testing was performed. Results as seen in FIG. 23 indicated that variant 2-6 binding was similar to CR3022, which is a positive control.

The data shows that the SARS-CoV-2 and ACE2 variant antibodies have high specificity and affinity to their antigen targets with affinities in the picomolar to nanomolar range.

Example 6. SARS-CoV-2 S1 and ACE2 Variants SARS-CoV-2 S1 and ACE2 variants were generated and panned as described in Examples 4 and 5.

FIG. 7 shows a schema of the panning strategy. Biotinylated antigen was bound to streptavidin coated magnetic beads at a density of 100 pmol antigen per mg of beads (Thermo Fisher #11206D). Phage libraries were blocked with 5% BSA in PBS. Following magnetic bead depletion for 1 hour at room temperature (RT), the beads were removed, and phage supernatant was transferred to 1 mg of antigen-bound beads in 1 ml PBS and incubated at RT with rotation for 1 hour. Non-binding clones were washed away by addition of 1 ml PBST, increasing the number of washes with each panning round. Trypsin was used to elute the phage bound to the antigen-bead complex. Phage were amplified in TG1 $E.\ coli$ for the next round of selection. This selection strategy was repeated for four rounds, with successively lower amounts of antigen per round. Following all four selection rounds, 400 clones from each of round 2, 3, and 4 were selected for phage expression and phage ELISA screening. Data from the panning is seen in Table 11.

TABLE 11

Panning Data

| Antibody | Library | R1 | R2 | R3 | R4 | R5 |
|---|---|---|---|---|---|---|
| 5 | Target | S1 | S1 | S1 | S1 | S1 |
|  | Input Titer | $2.0 \times 10^{13}$ | $1.2 \times 10^{13}$ | $7.0 \times 10^{12}$ | $1.0 \times 10^{13}$ |  |
|  | Output Titer | $3.5 \times 10^{6}$ | $8.0 \times 10^{6}$ | $4.0 \times 10^{7}$ | $3.2 \times 10^{8}$ |  |
| 6 | Target | S1 | S1 | S1 | S1 | S1 |
|  | Input Titer | $2.0 \times 10^{13}$ | $1.2 \times 10^{13}$ | $1.0 \times 10^{13}$ | $1.0 \times 10^{13}$ |  |
|  | Output Titer | $2.5 \times 10^{7}$ | $3.6 \times 10^{6}$ | $6.0 \times 10^{7}$ | $1.2 \times 10^{8}$ |  |

Figure 24A:
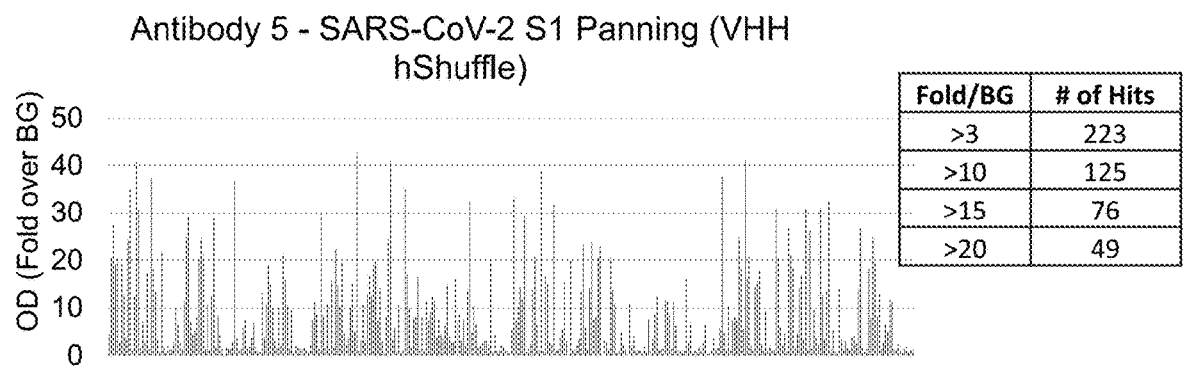
FIGS. 24A-24B are graphs of phage ELISA data from panning data for antibody 5 (FIG. 24A) and antibody 6 (FIG. 24B).
Figure 24B:
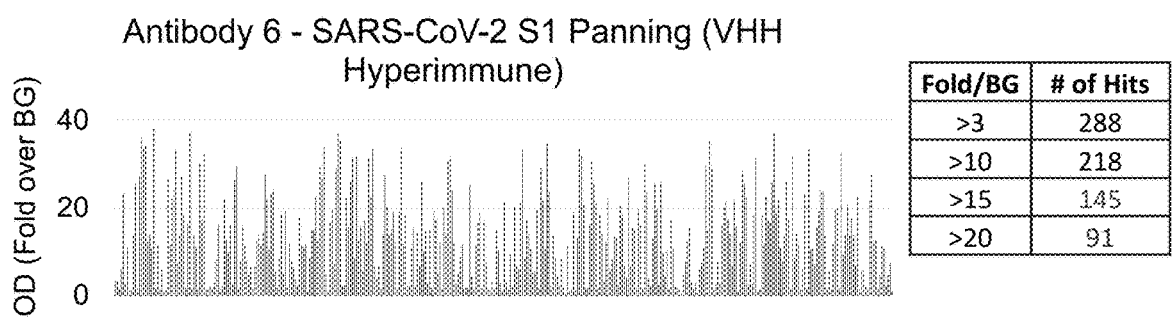
Figure 25A:
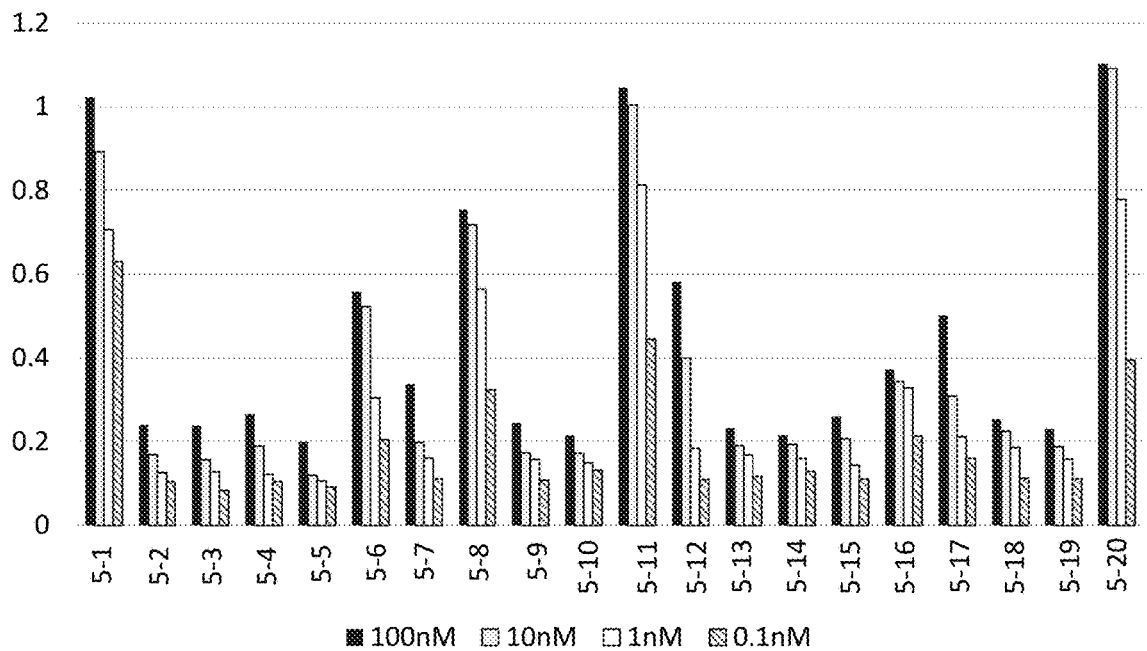
FIGS. 25A-25H are graphs of phage ELISA for antibody 5 variants.
Figure 25B:
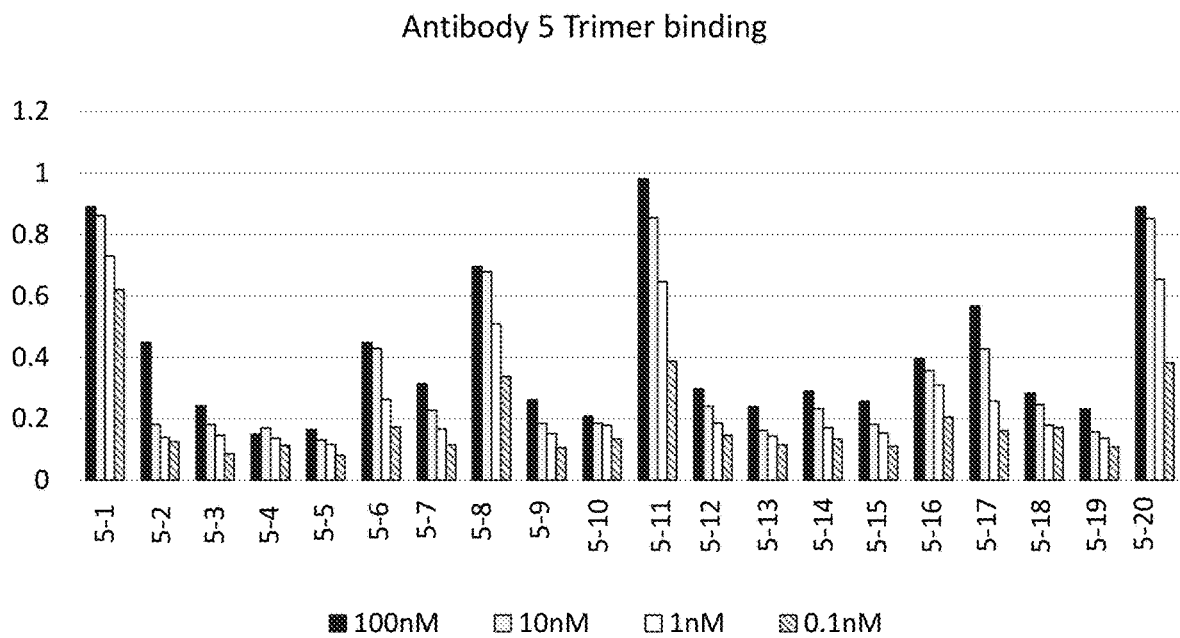
Figure 25C:
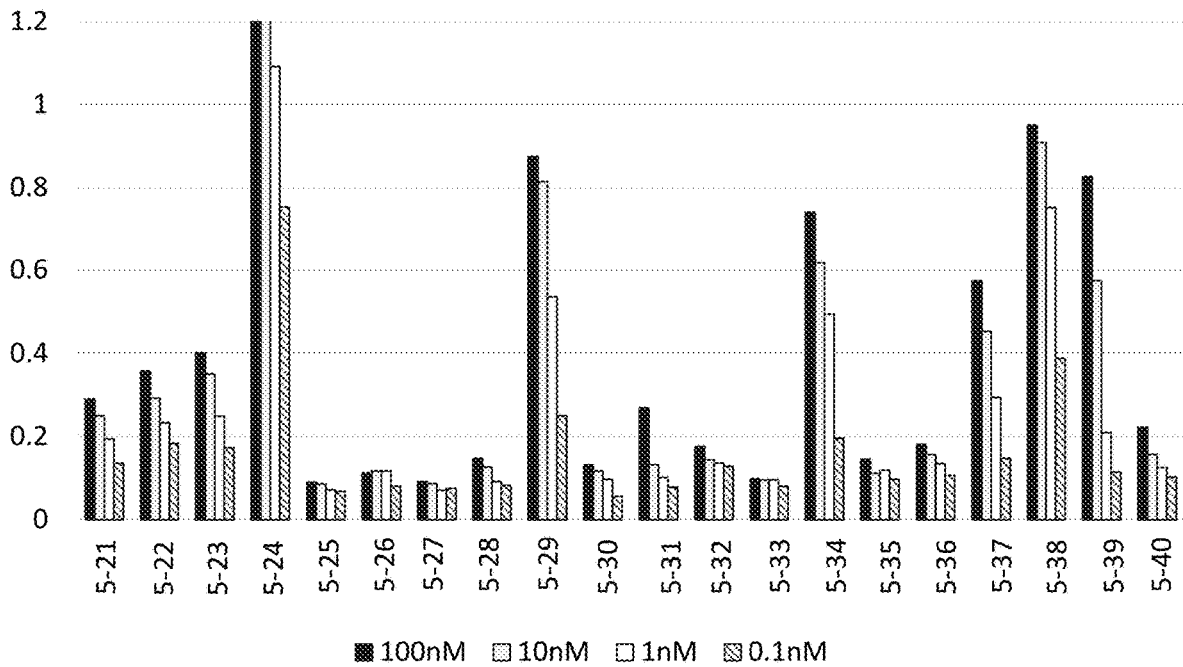
Figure 25D:
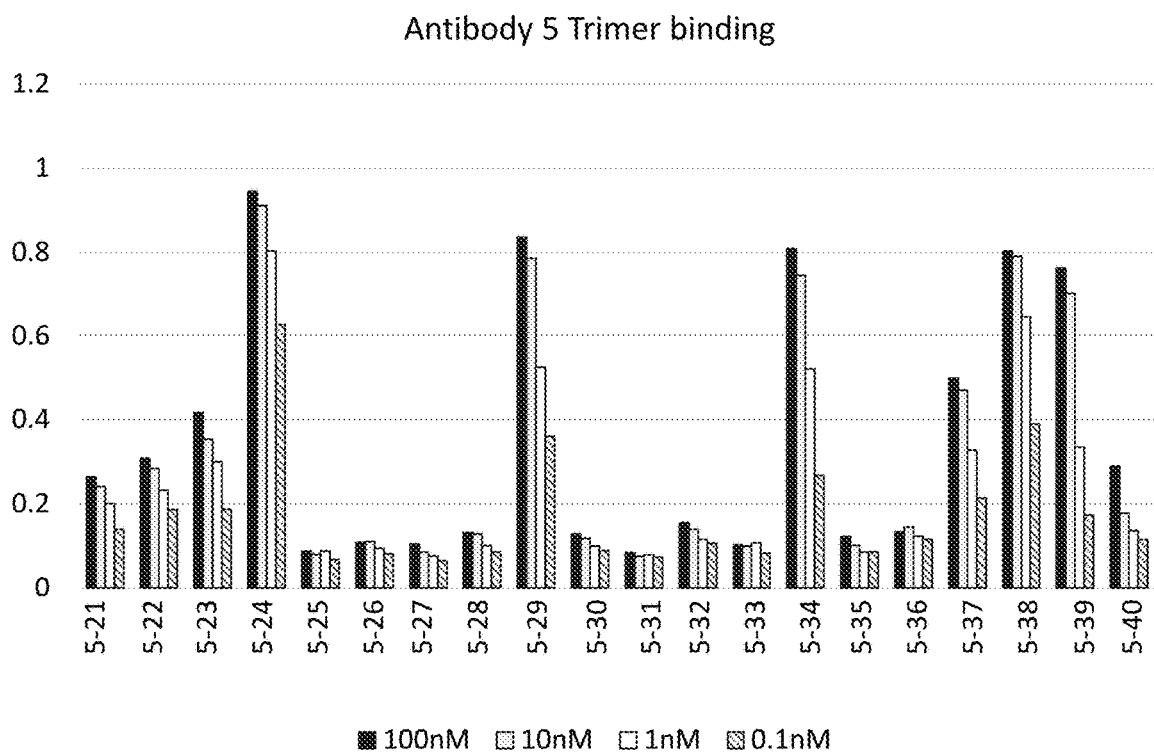
Figure 25E:
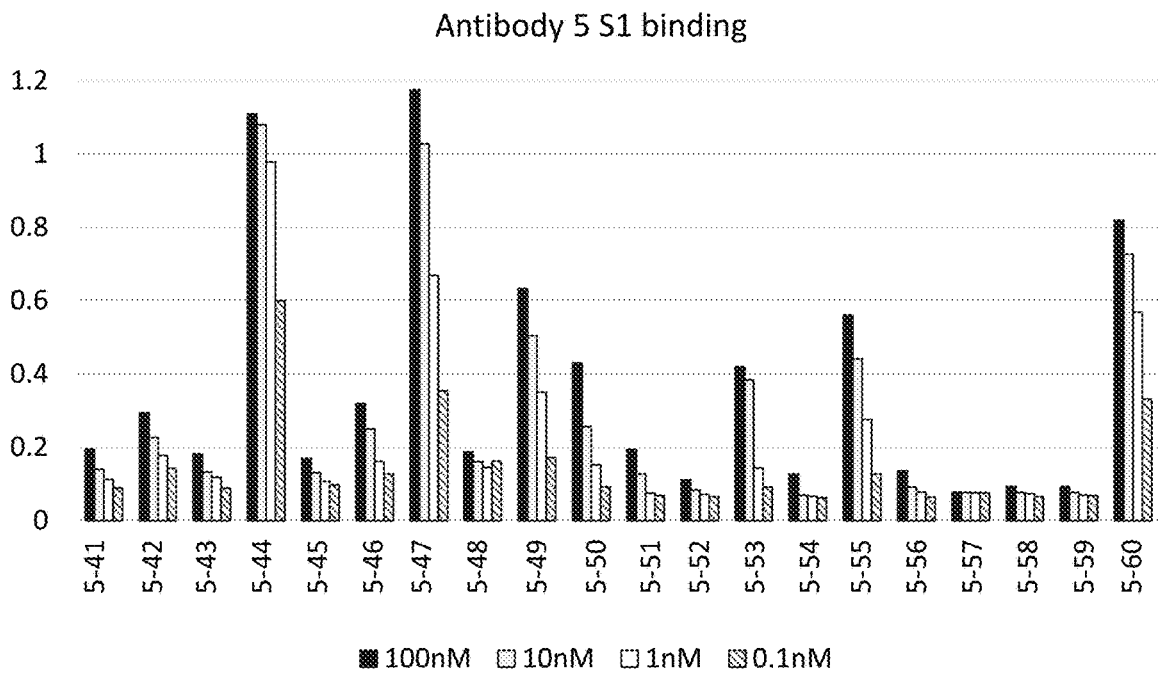
Figure 25F:
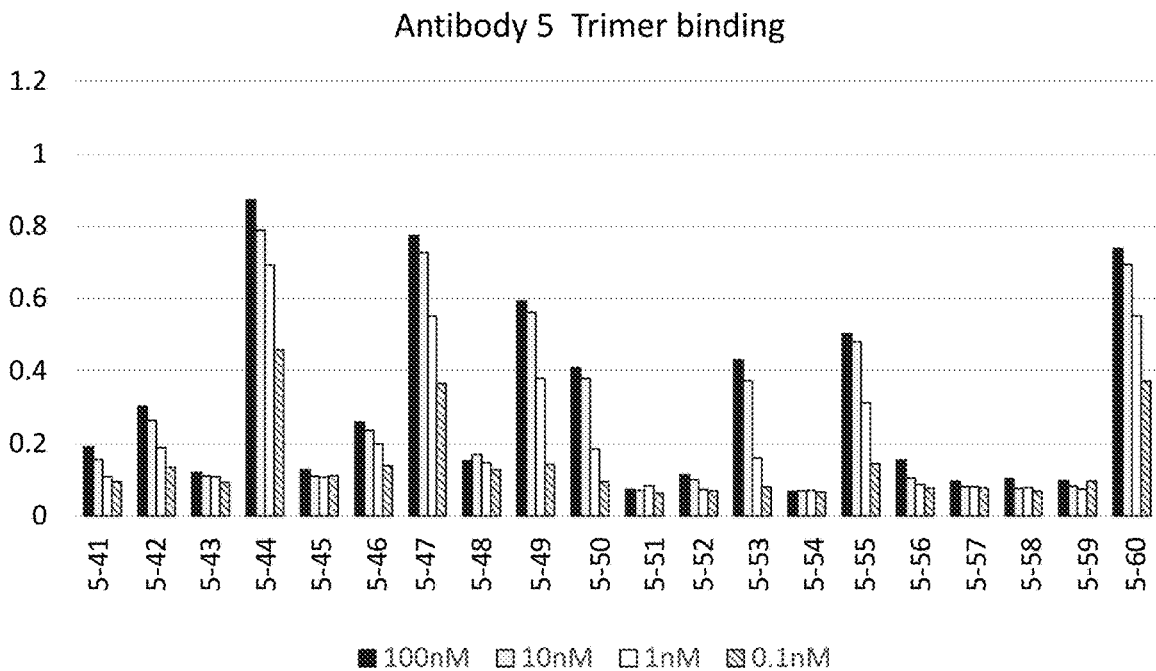
Figure 25G:
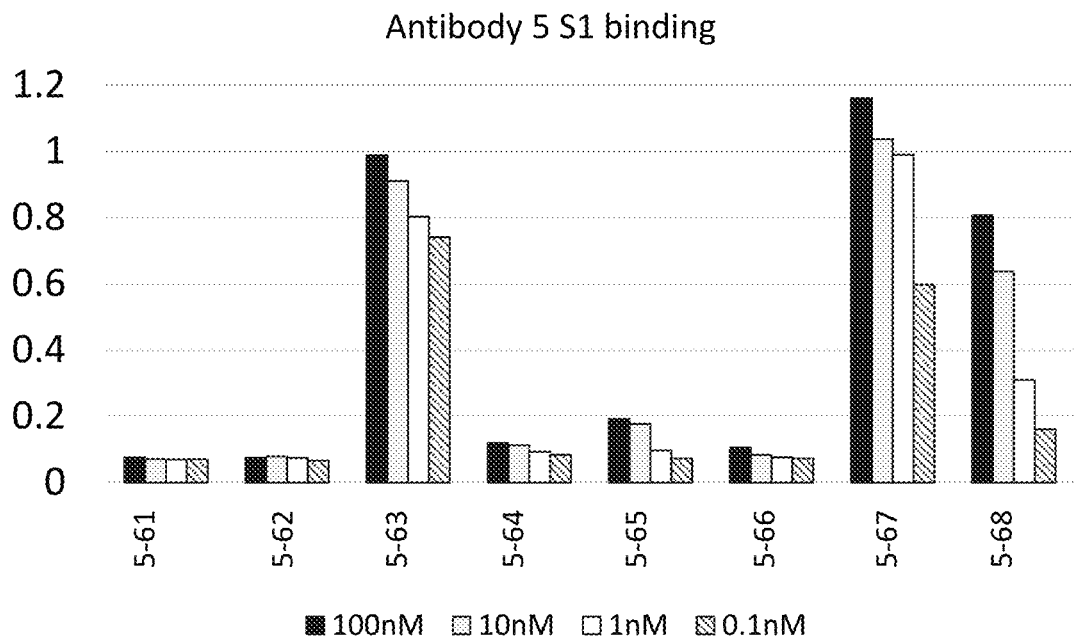
Figure 25H:
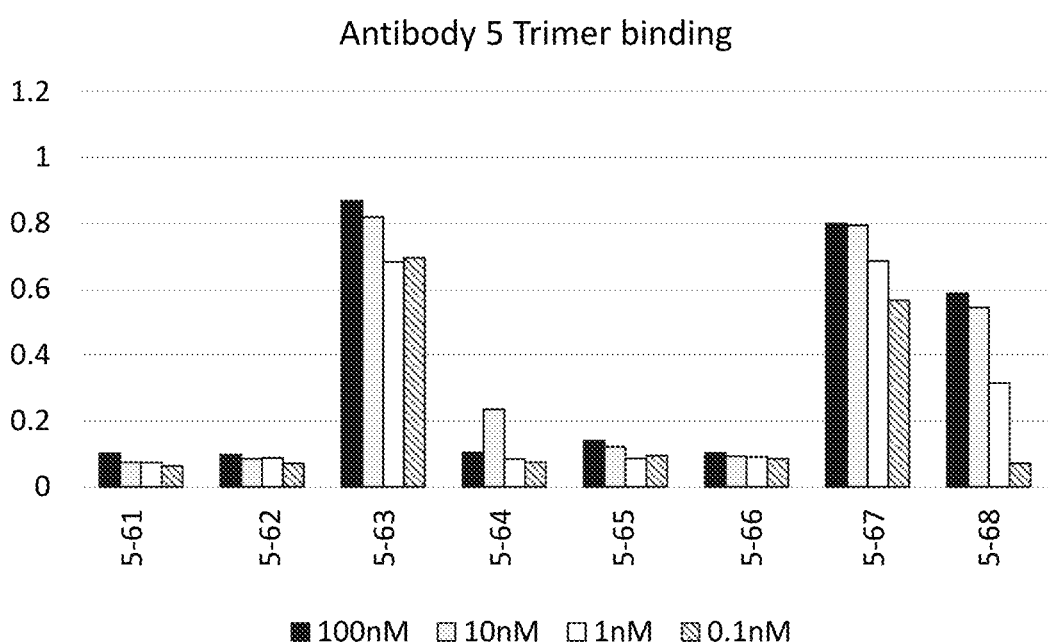
Figure 26A:
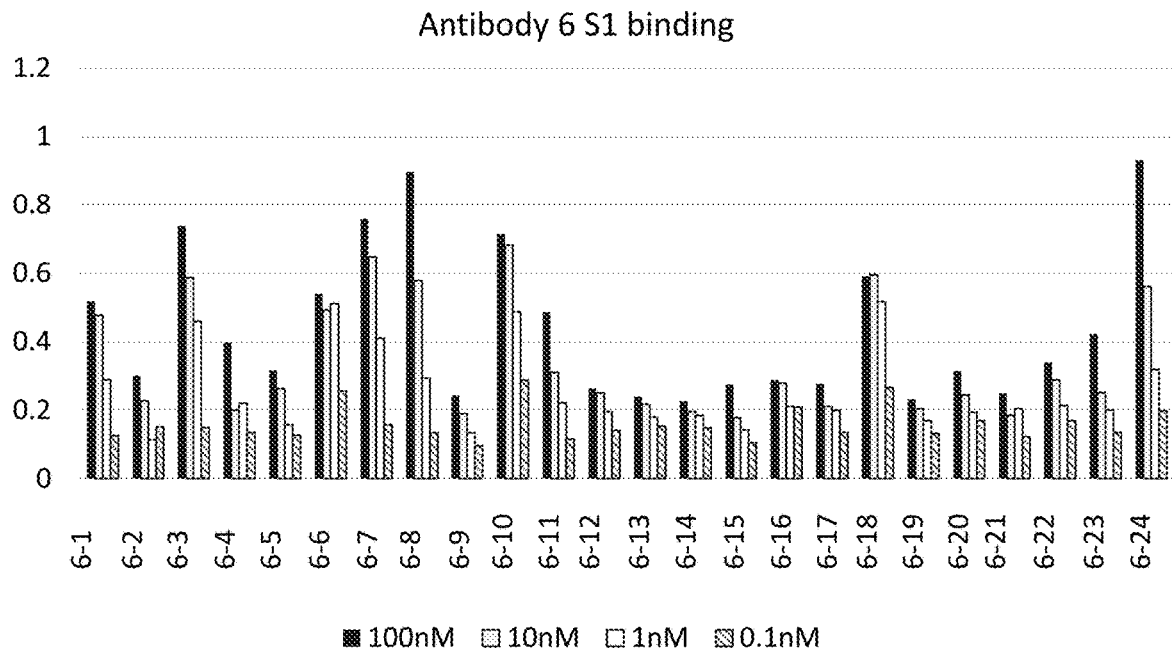
FIGS. 26A-26J are graphs of phage ELISA for antibody 6 variants.
Figure 26B:
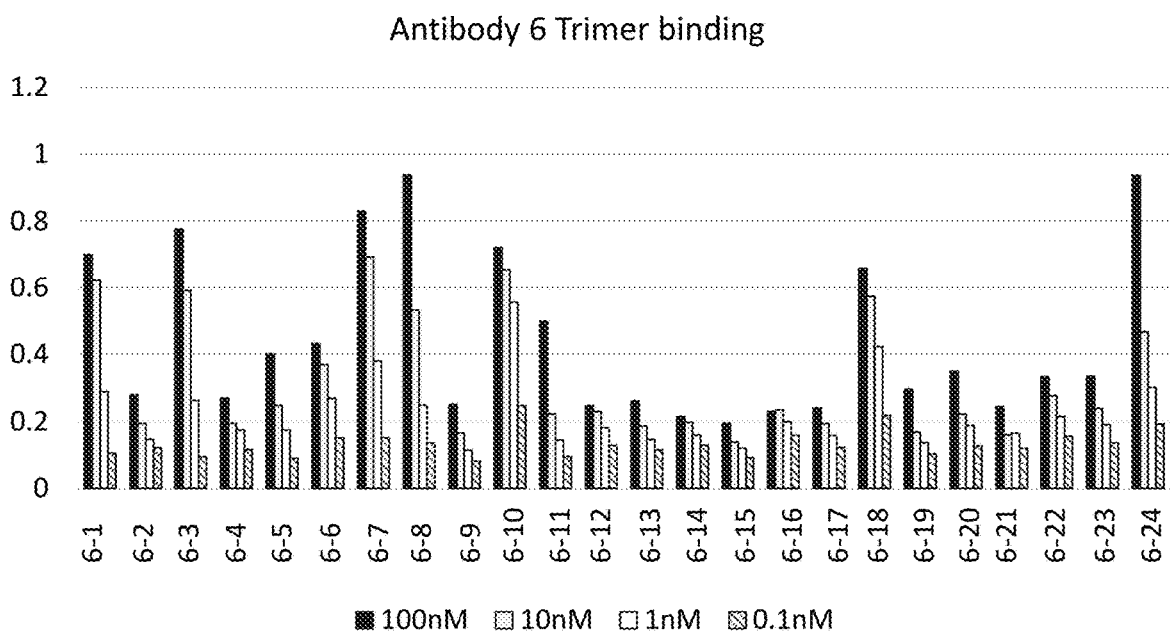
Figure 26C:
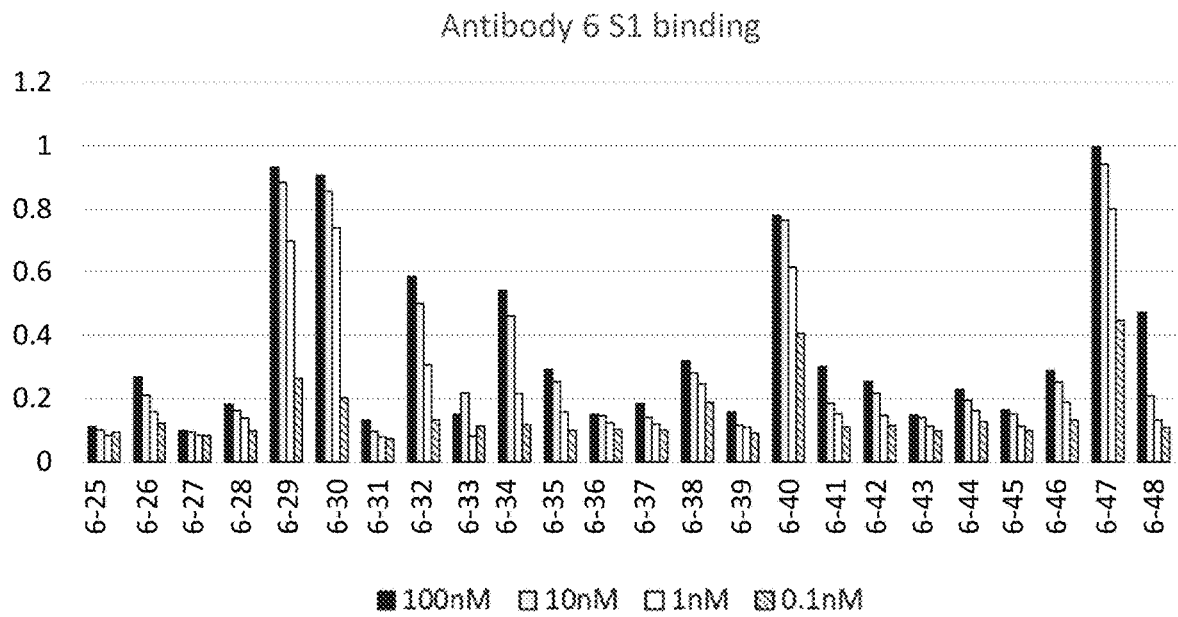
Figure 26D:
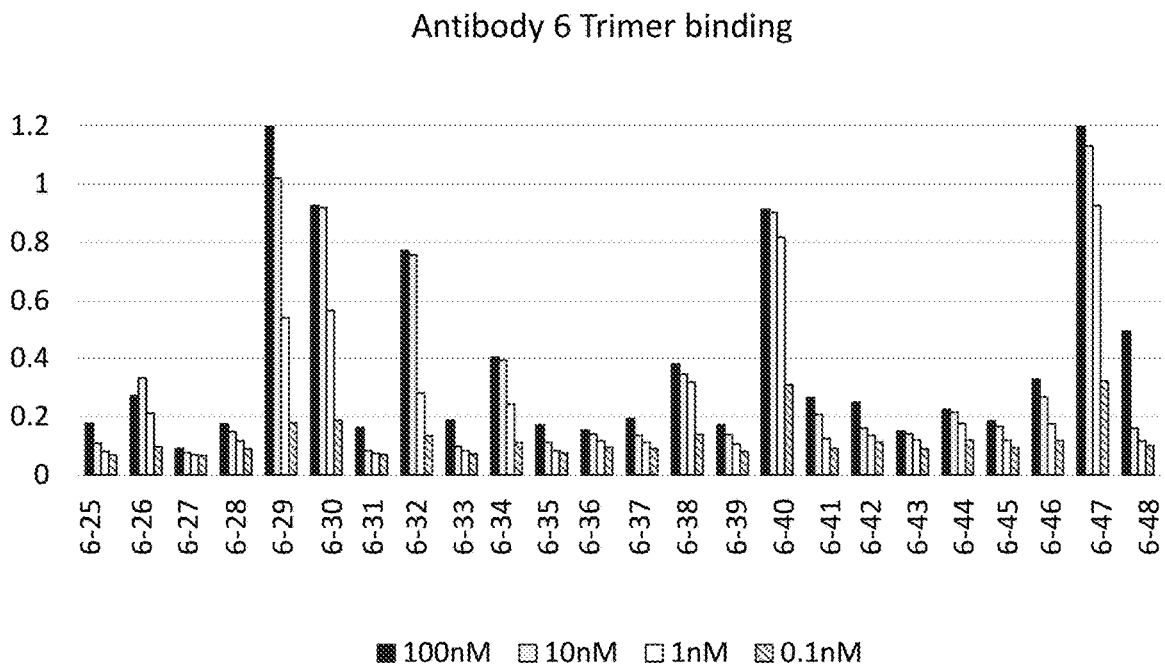
Figure 26E:
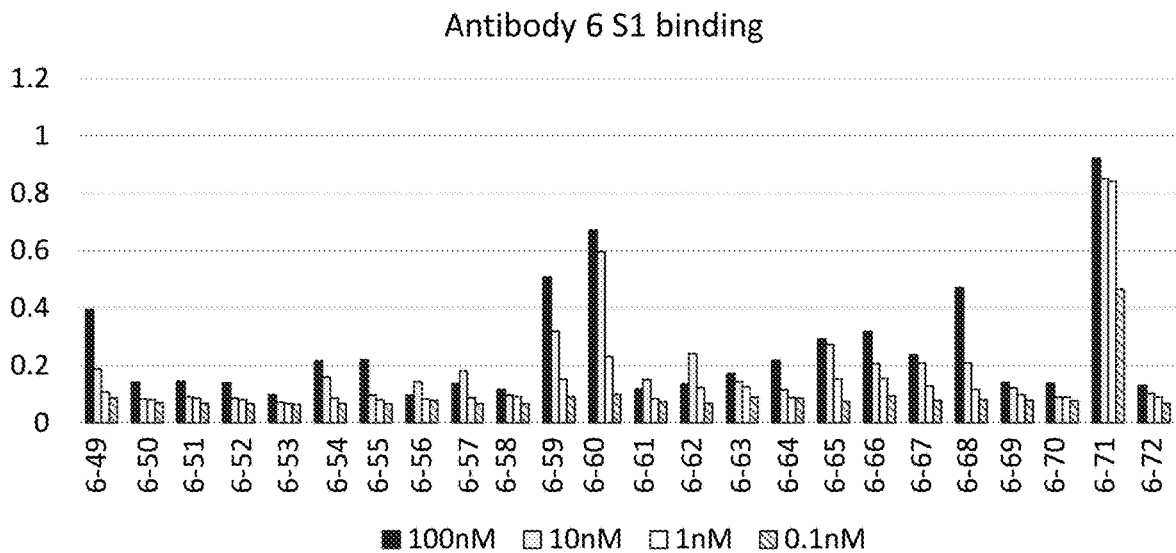
Figure 26F:
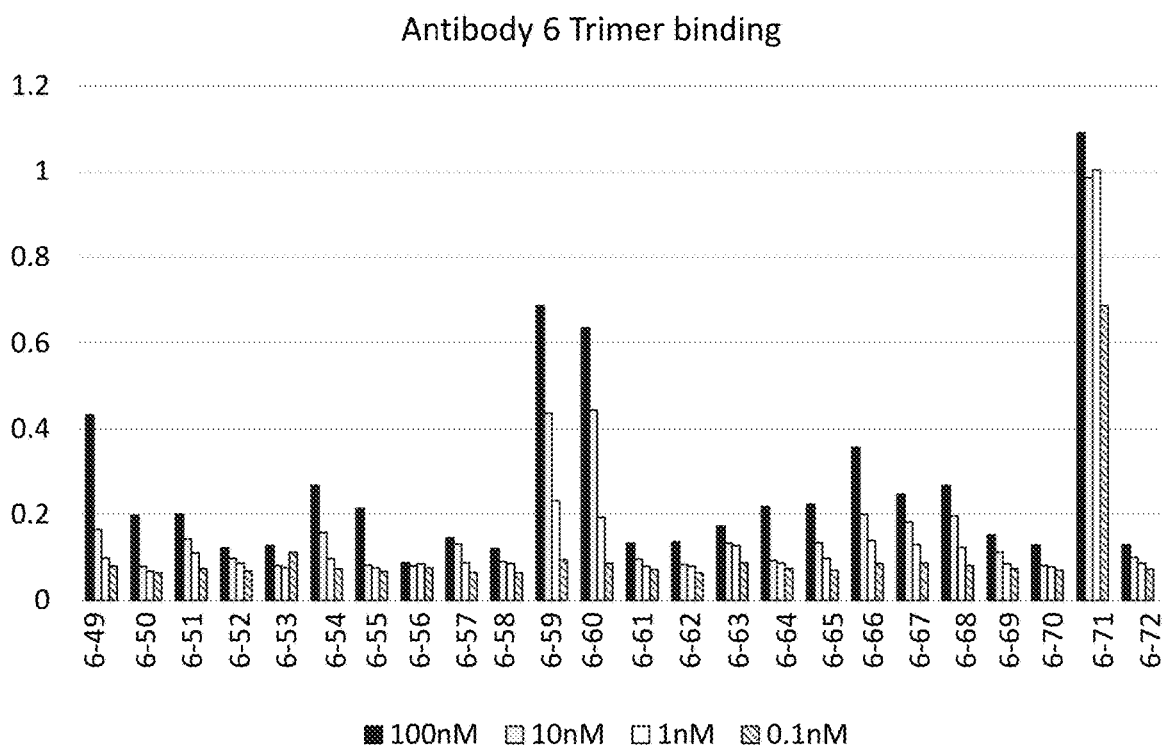
Figure 26G:
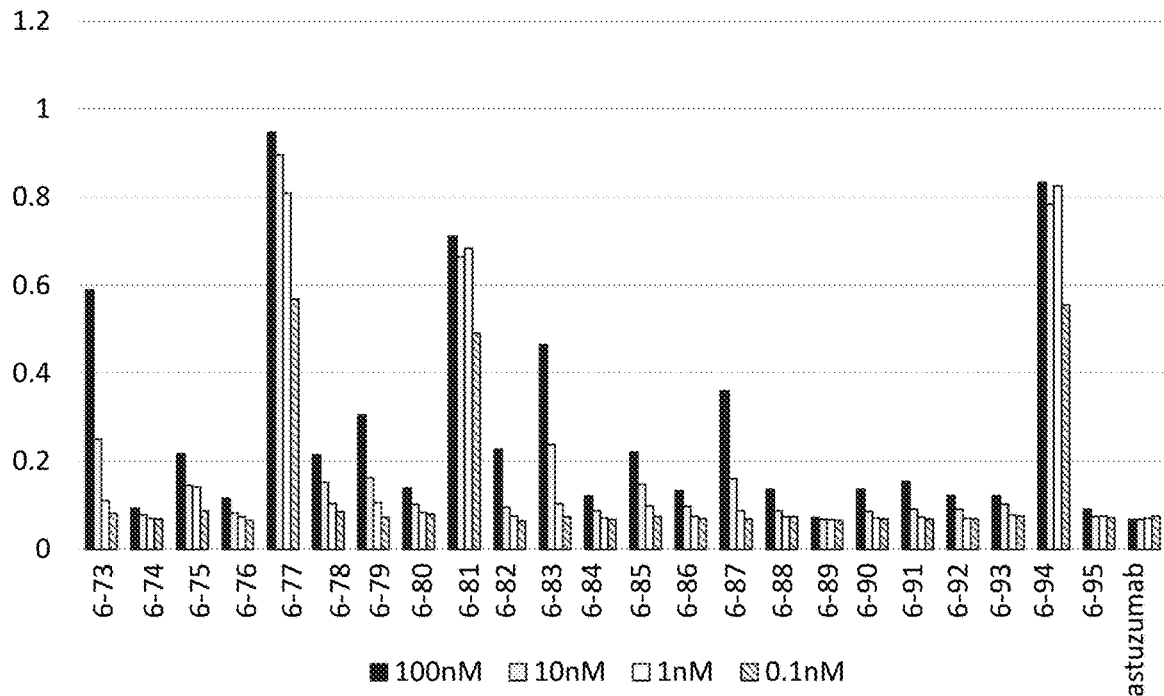
Figure 26H:
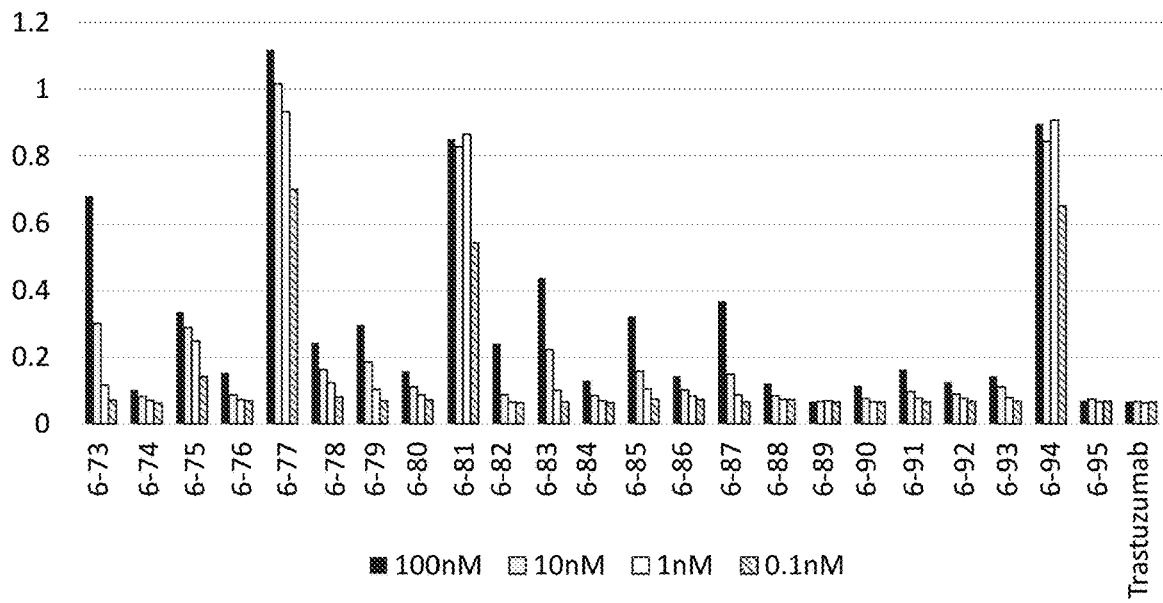
Figure 26I:
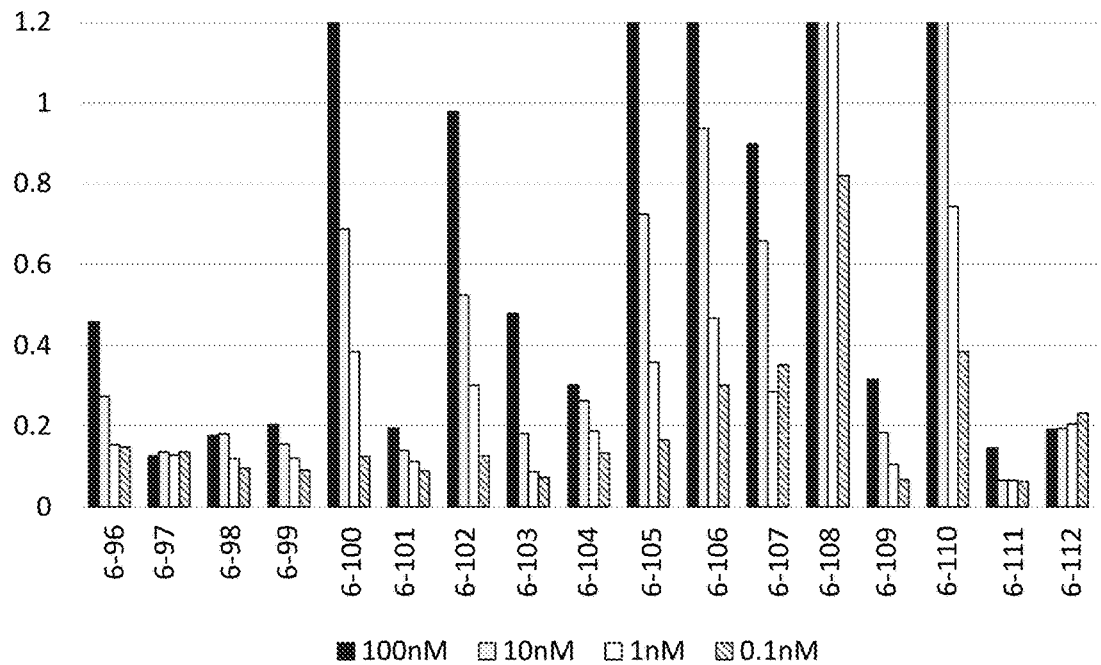
Figure 26J:
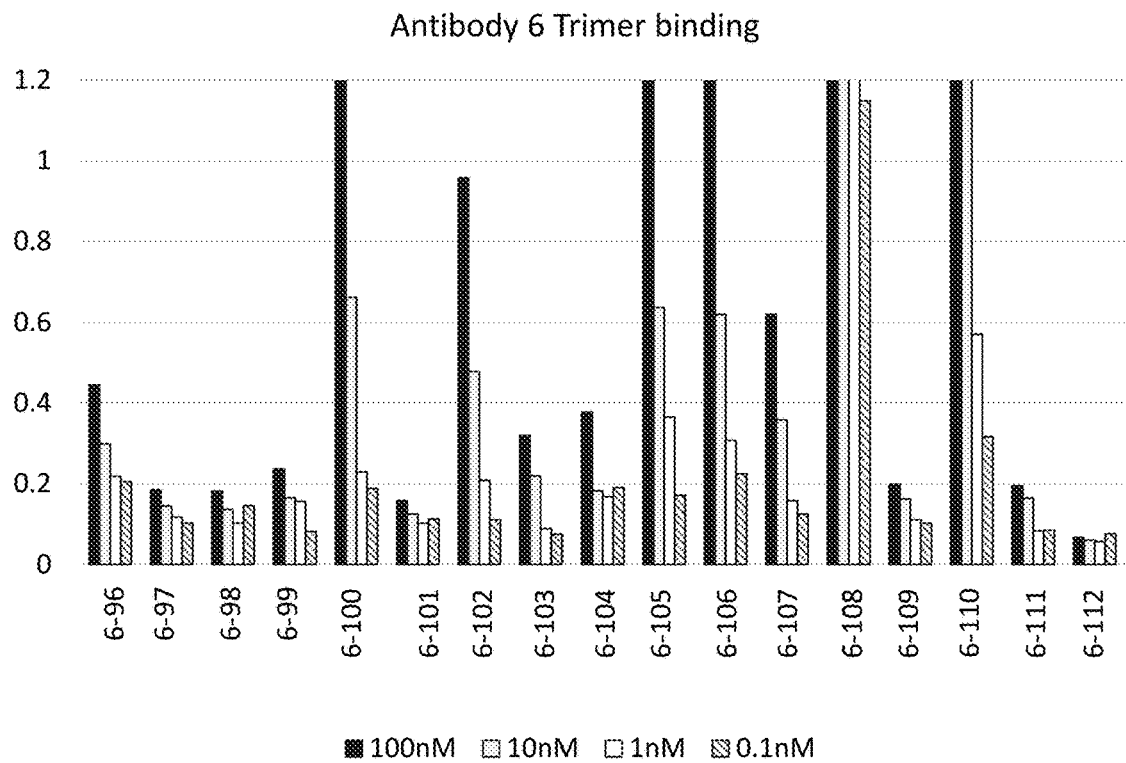

To test for binding to SARS-CoV-2 S1, phage were expressed from each picked colony by KO7 superinfection in 384 well microtiter plates. Phage containing supernatant was blocked by 1:1 addition of 4% non-fat milk (NFM). Assay plates were prepared by passive immobilization of 0.4 μg antigen in 384-well Maxisorp plates (Thermo Fisher #464718) and then blocked with 4% NFM. Following 3× wash in PBST, blocked phage supernatant was incubated for 1 hour at RT. After 3× wash in PBST, 0.3 μg/ml anti-M13-HRP (Sino Biological #11973-MM05T-H) was aliquoted for 1 hour incubation at room temperature. Binding of phage-displayed antibody was determined by absorbance at 450 nm with 3,3′,5,5′-tetramethylbenzidine (Thermo Fisher #34029). Phage that bound to antigen with 3× over background of human Fc protein were identified as potential binders for sequencing analysis. DNA was amplified by rolling circle amplification from glycerol stocks of each clone and submitted for Sanger sequencing (Genewiz) to capture the VH and VL domains. FIGS. 24A-24B shows phage ELISA data from panning data for antibody 5 and antibody 6. For Antibody 5 variants, 116 unique clones and 68 unique CDRH3 were identified. For Antibody 6 variants, 136 unique clones and 112 CDRH3 were identified.

Figure 27A:
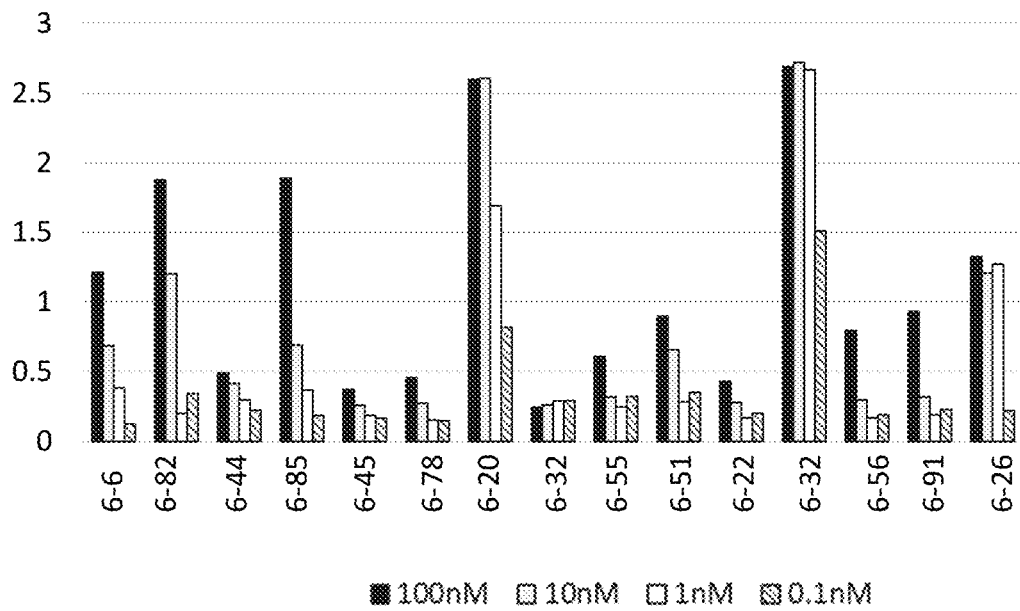
FIGS. 27A-27B are graphs of phage ELISA for select antibody 6 variants.
Figure 27B:
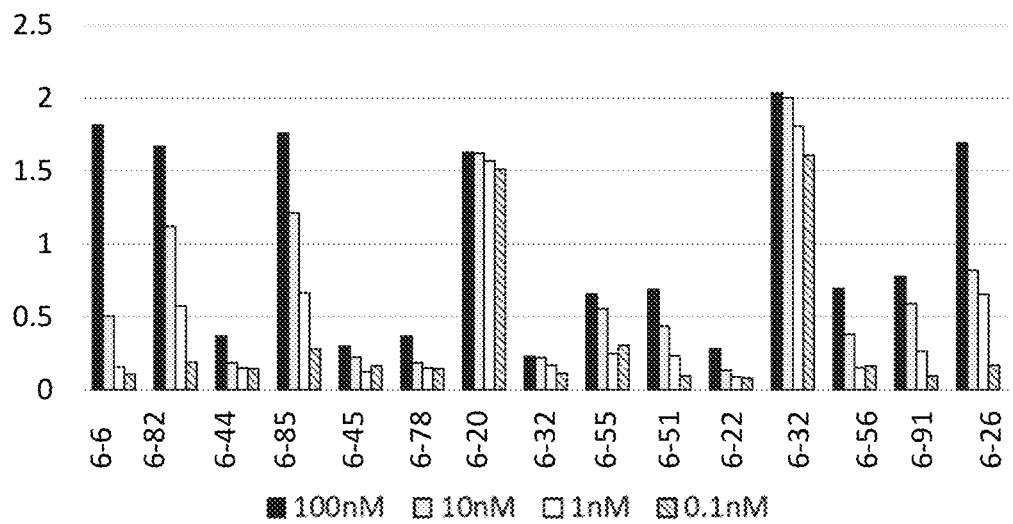
Figure 28A:
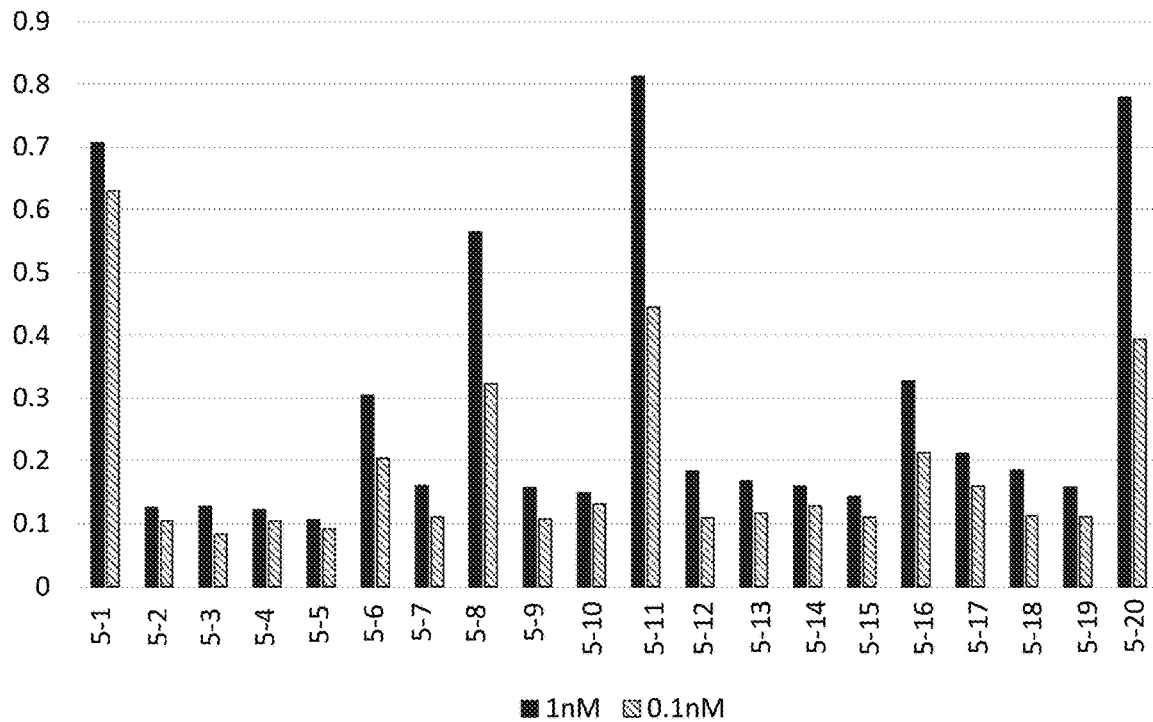
FIGS. 28A-28F are graphs of phage ELISA for antibody 5 variants using 1 nM and 0.1 nM concentrations of antibodies.
Figure 28B:
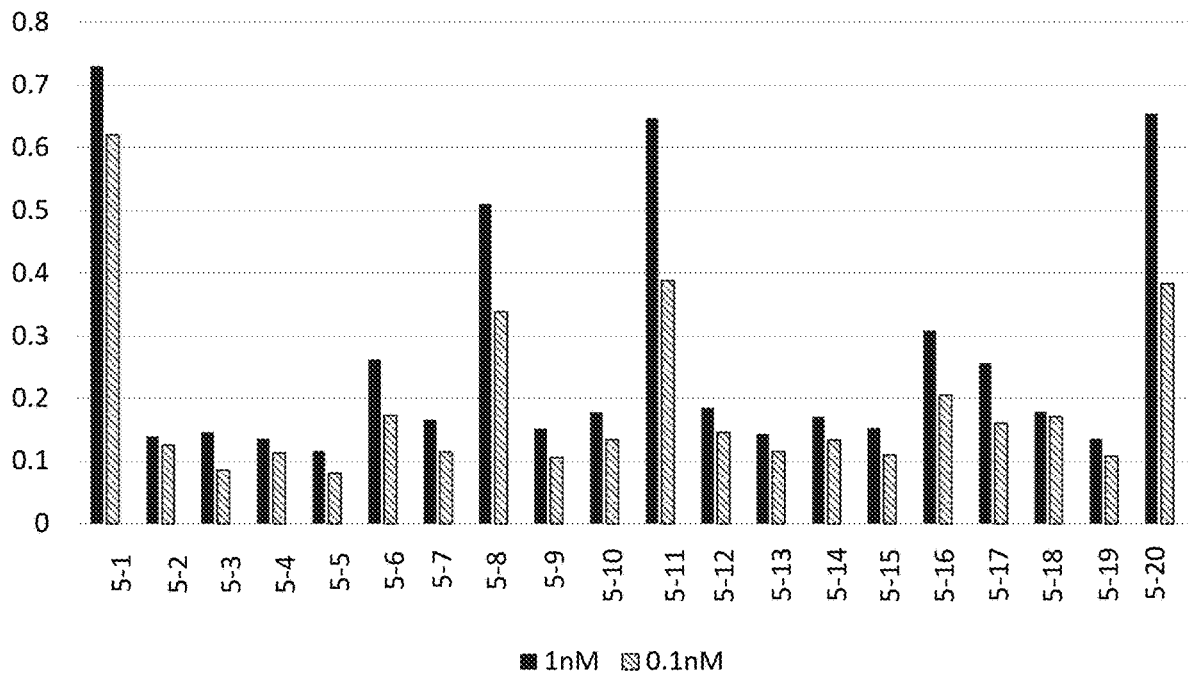
Figure 28C:
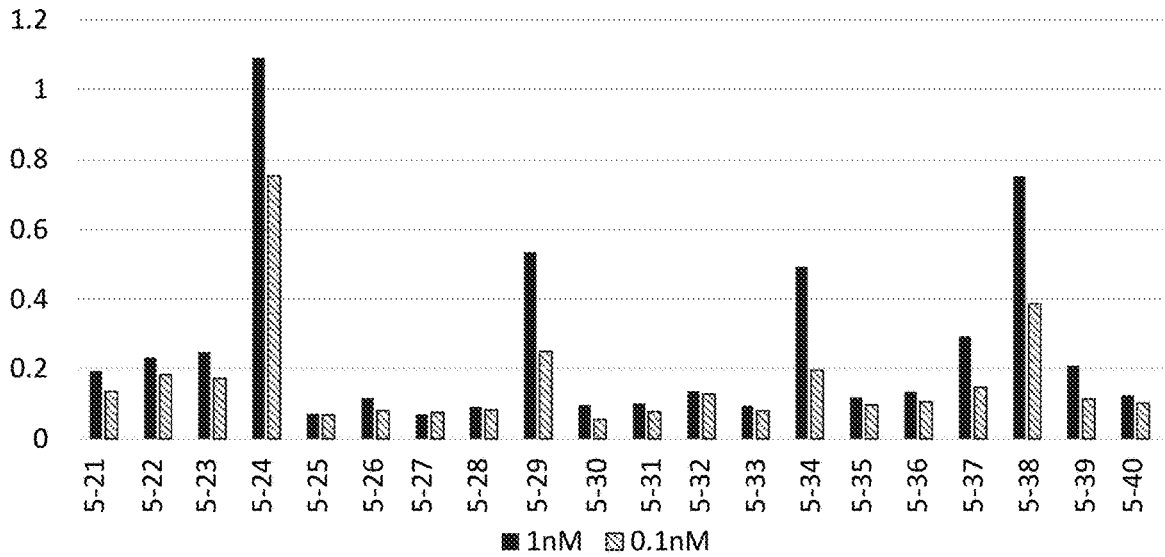
Figure 28D:
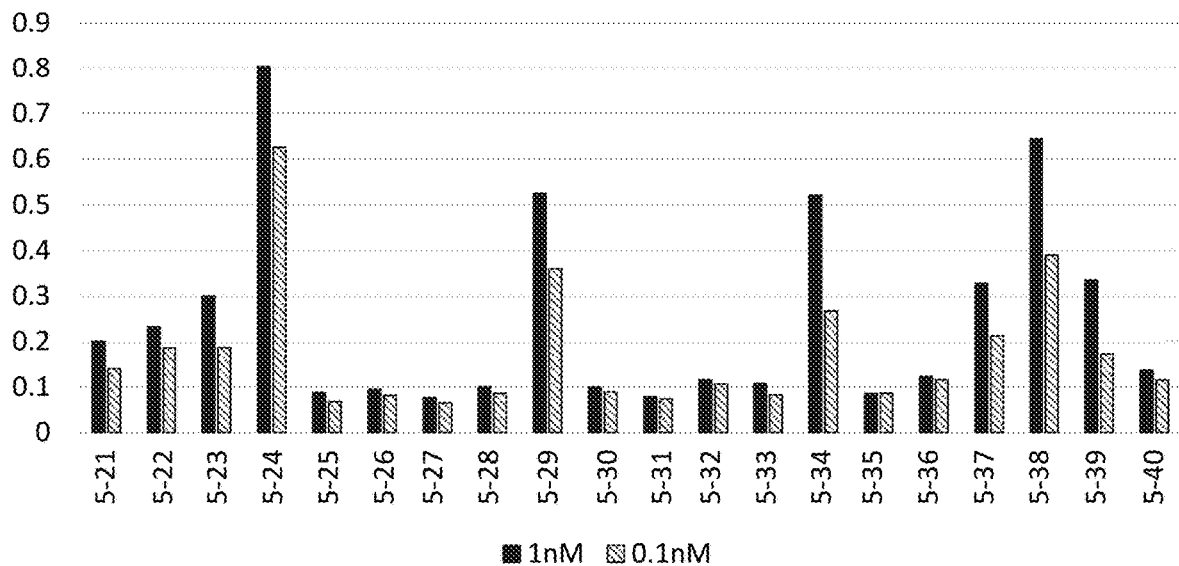
Figure 28E:
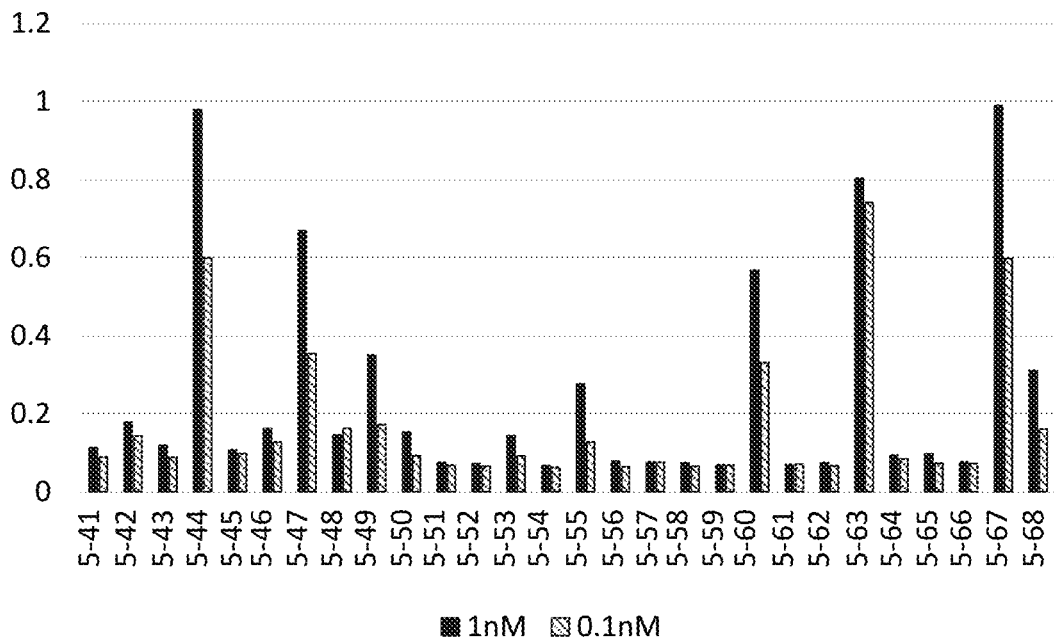
Figure 28F:
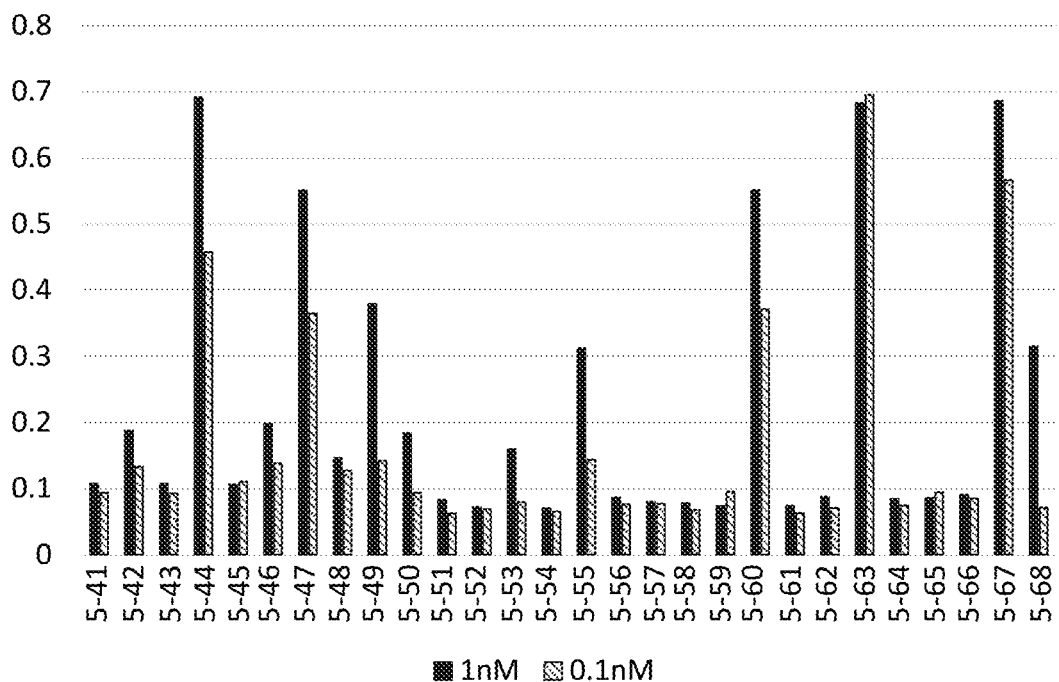
Figure 29A:
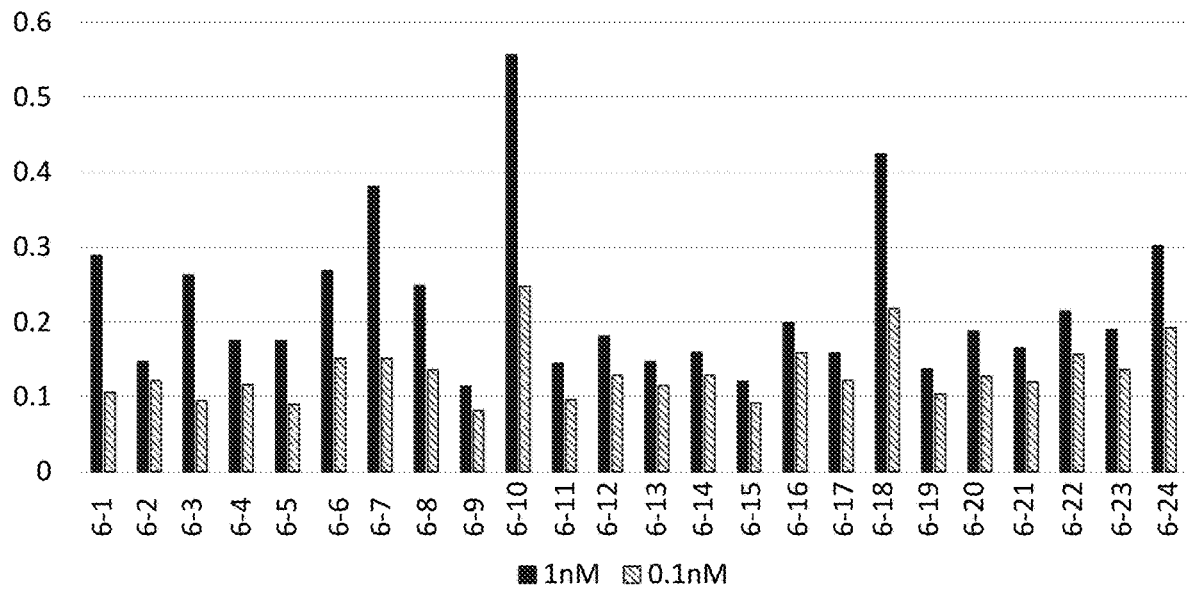
FIGS. 29A-29J are graphs of phage ELISA for antibody 6 variants using 1 nM and 0.1 nM concentrations of antibodies.
Figure 29B:
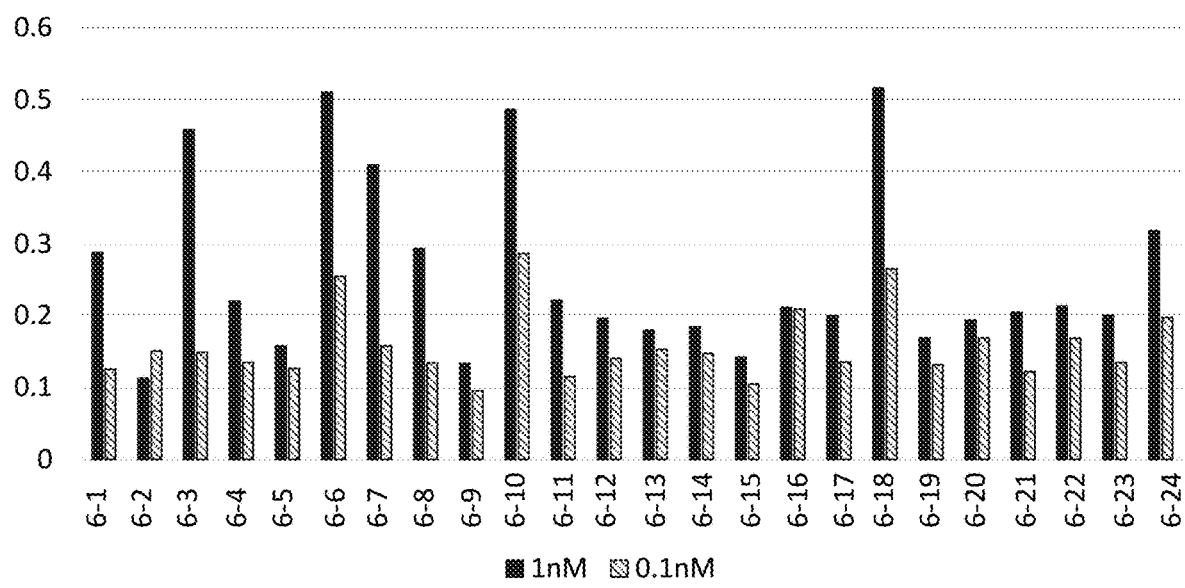
Figure 29C:
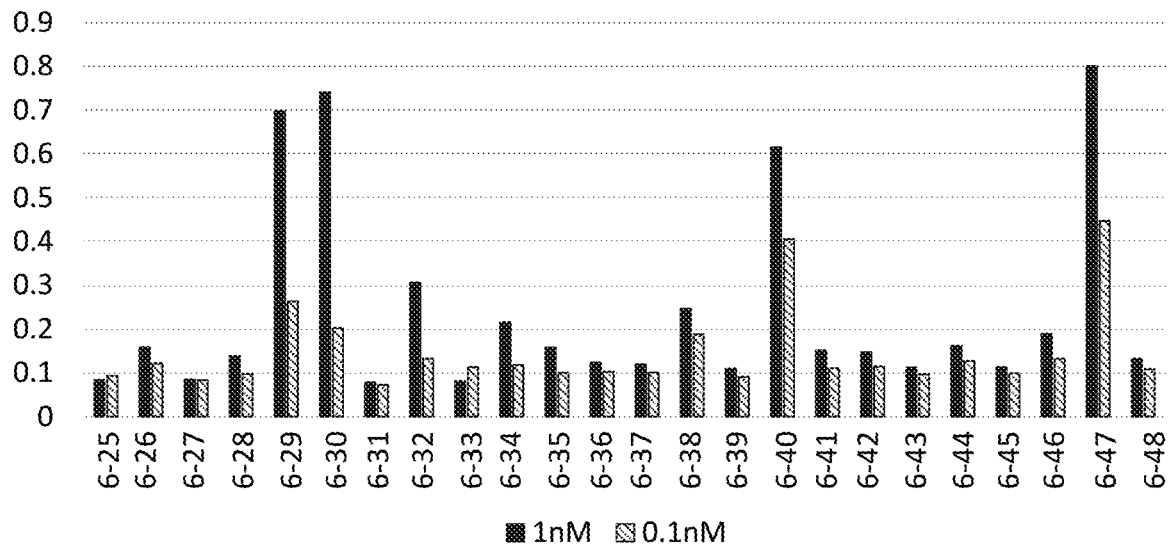
Figure 29D:
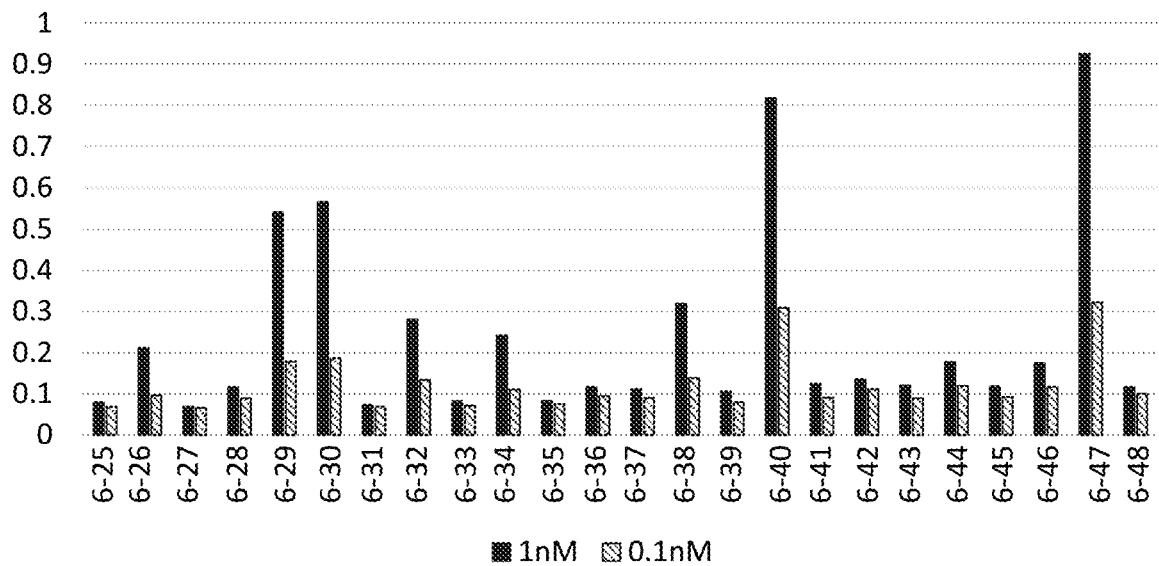
Figure 29E:
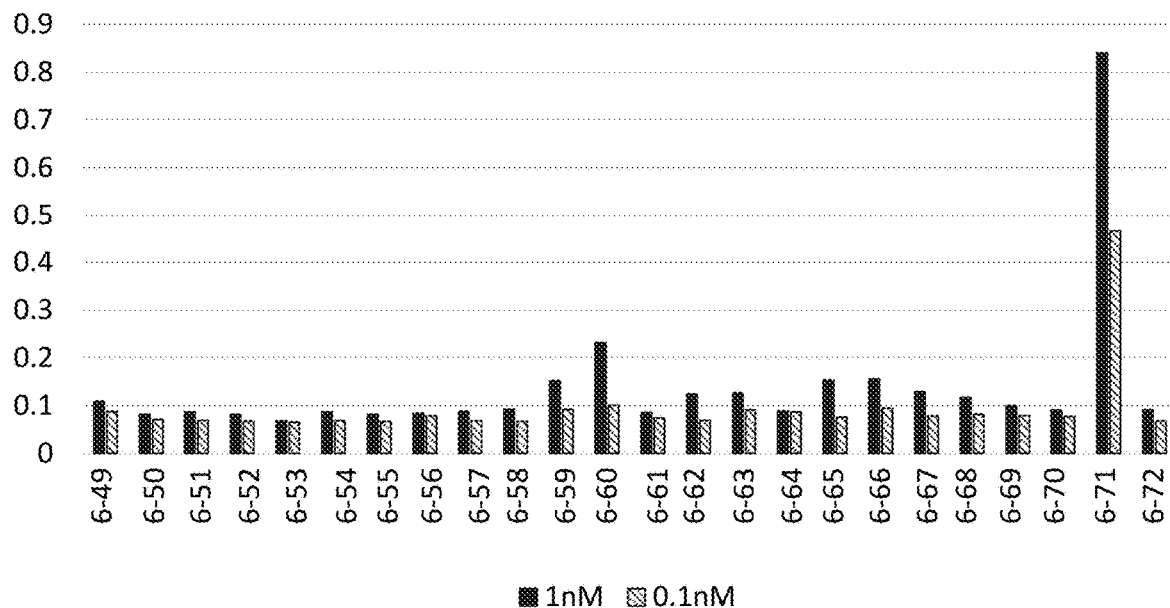
Figure 29F:
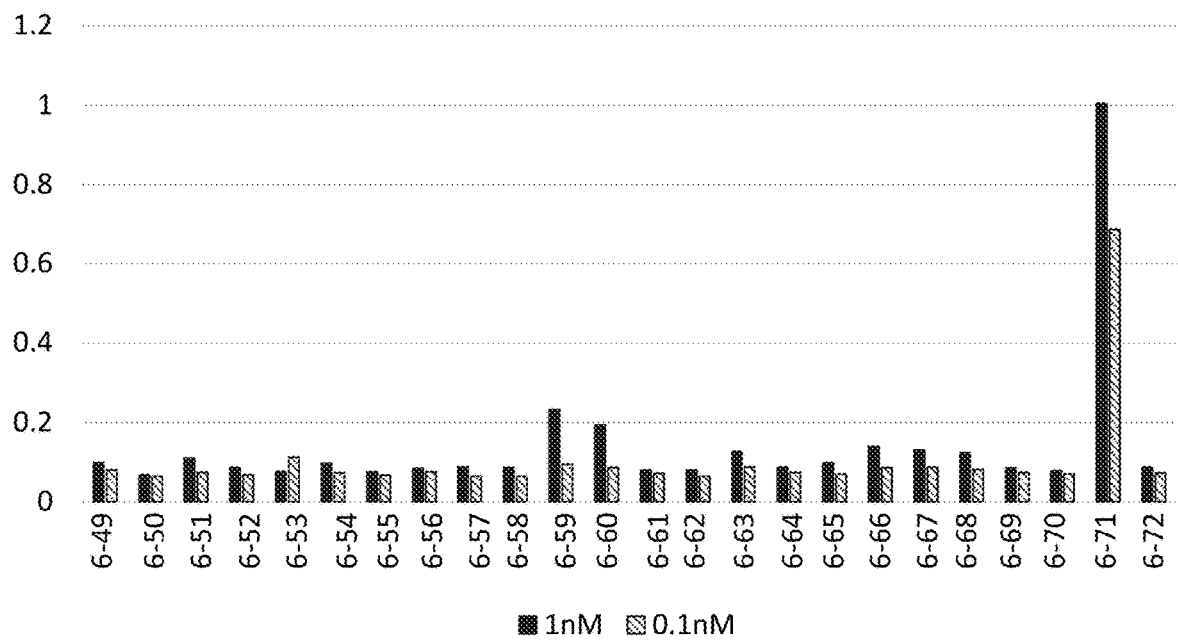
Figure 29G:
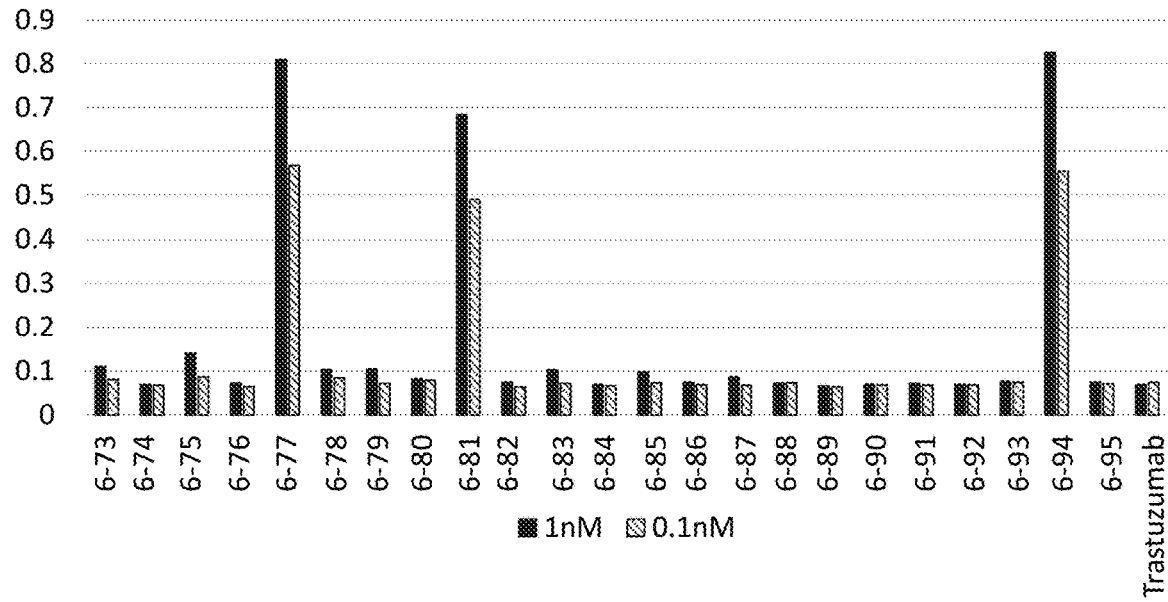
Figure 29H:
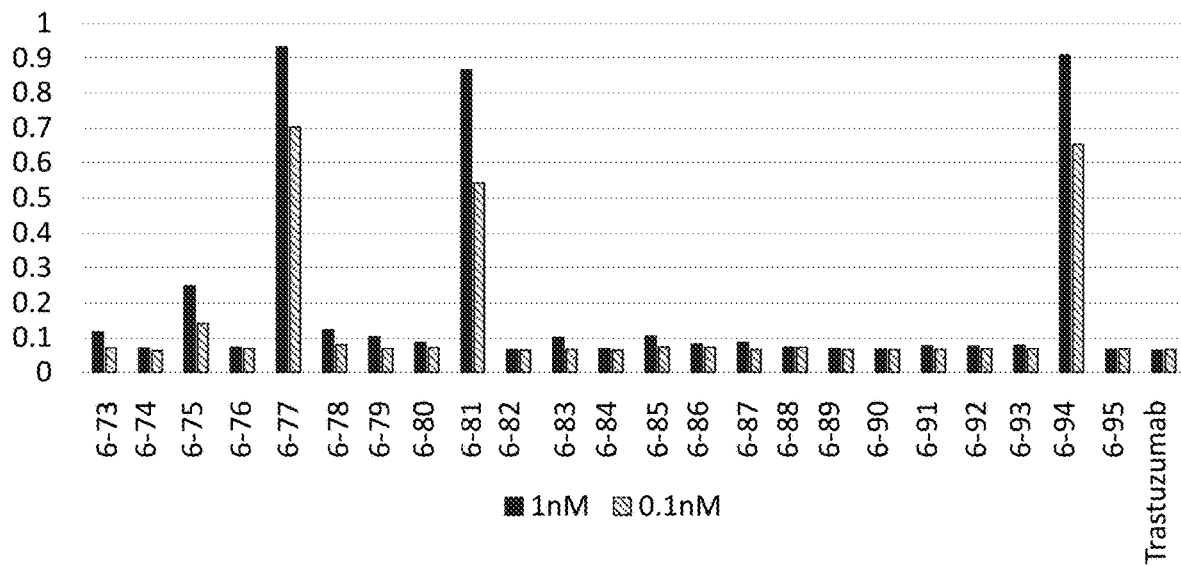
Figure 29I:
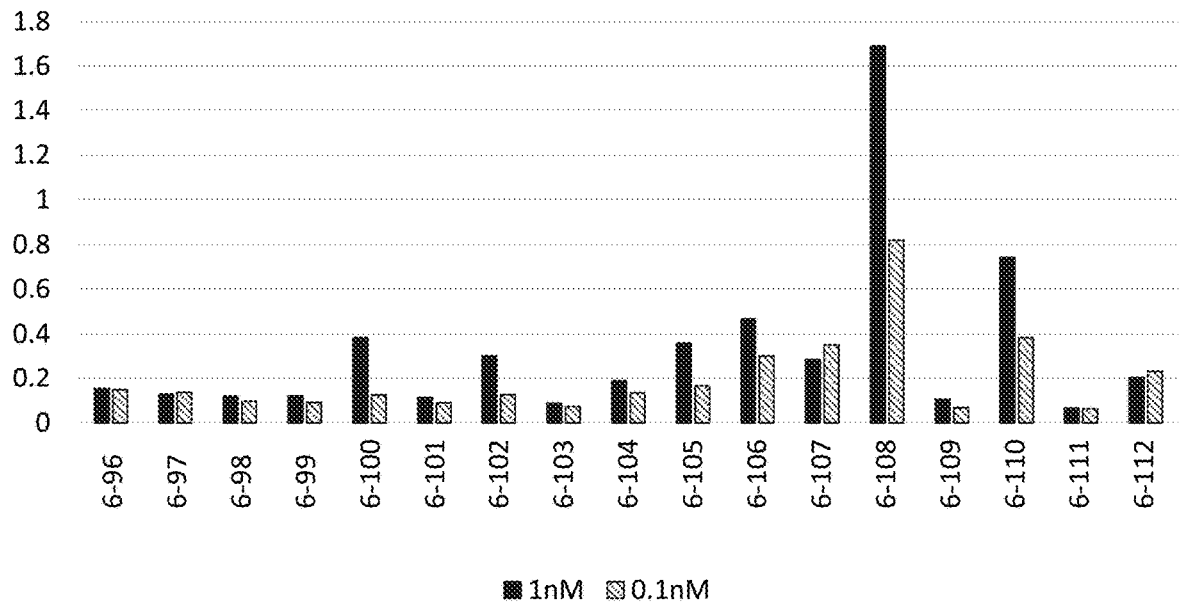
Figure 29J:
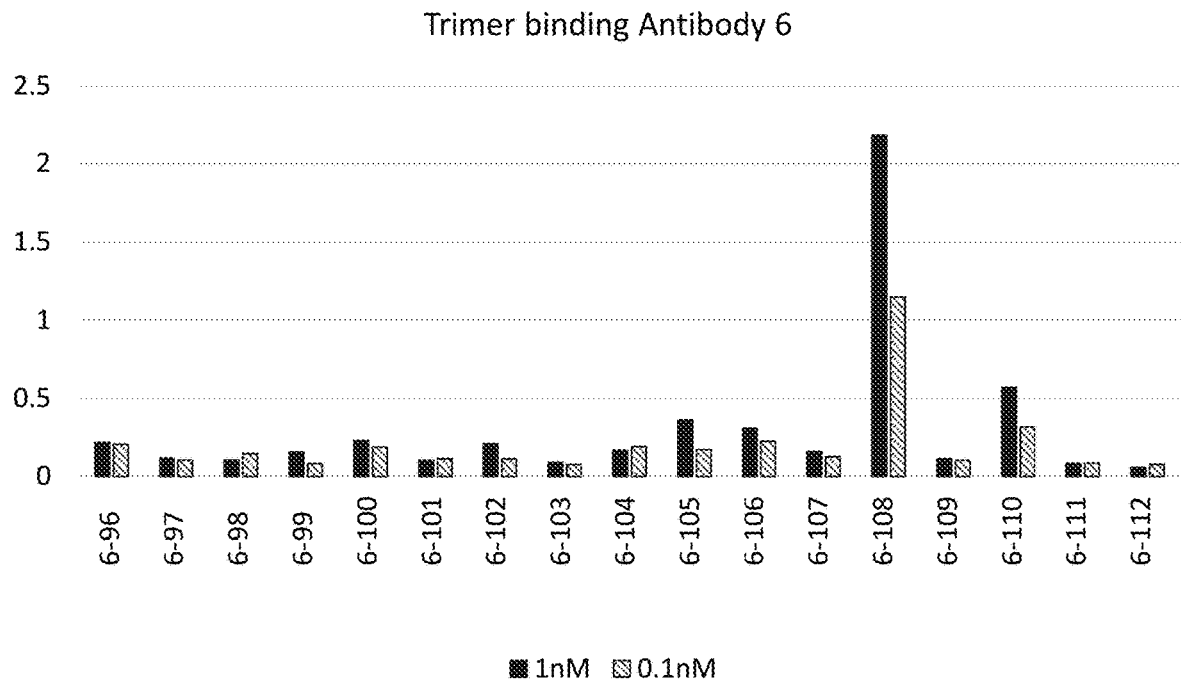
Figure 30A:
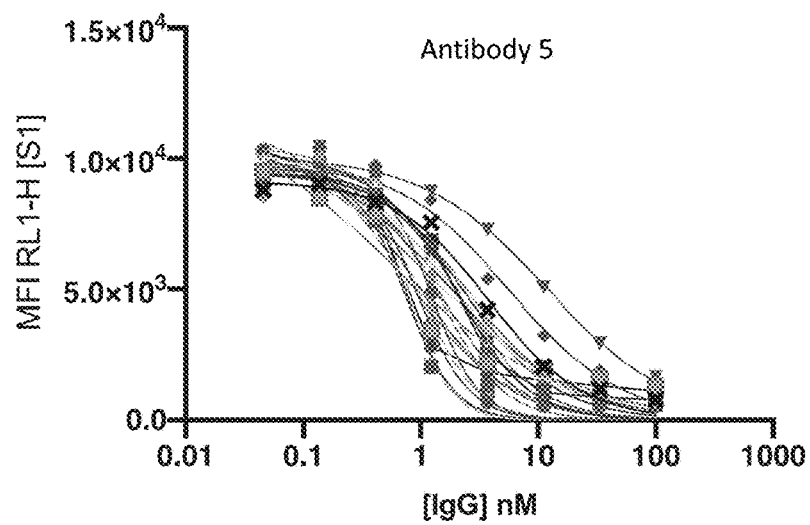
FIGS. 30A-30C are graphs of mean fluorescent intensity (MFI) plotted for each SARS-CoV-2 variant antibody dilution.
Figure 30B:
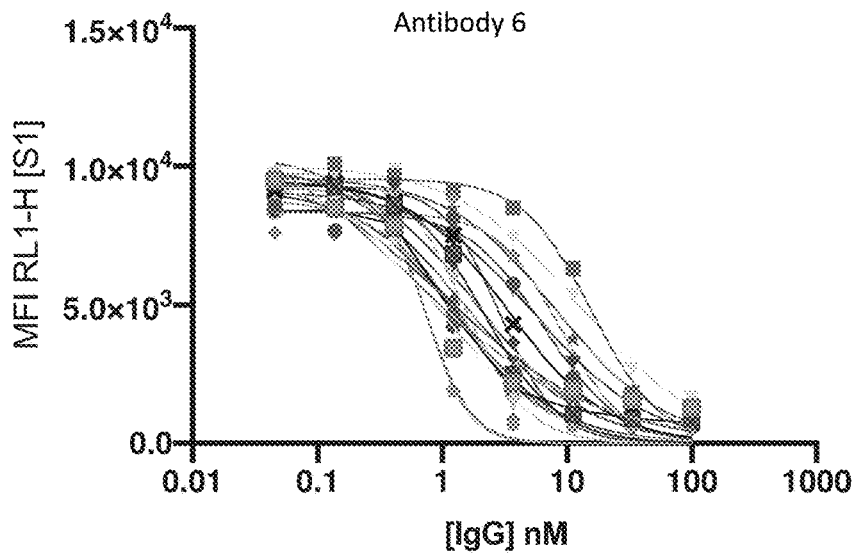
Figure 30C:
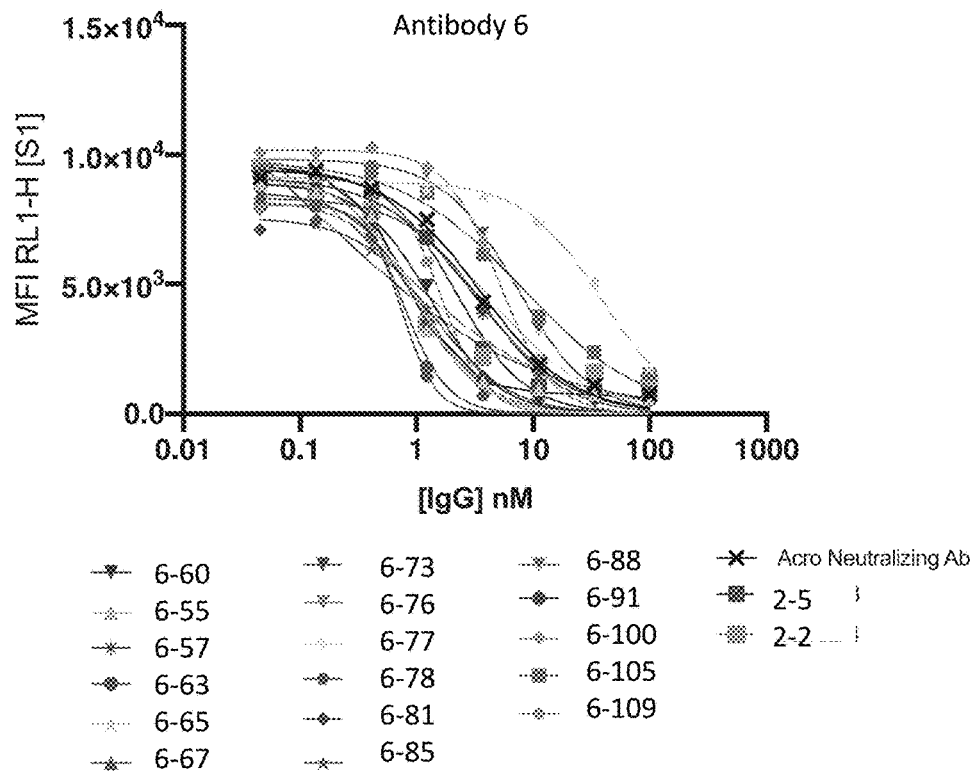
Figure 31A:
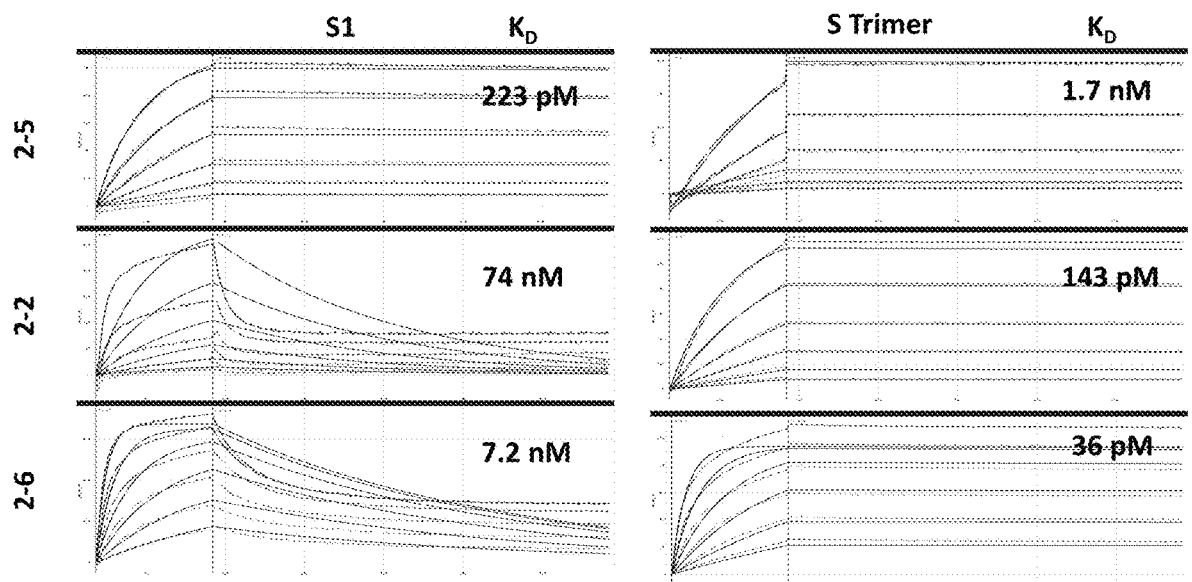
FIGS. 31A-31B are graphs of antibody kinetics for variants 2-5, 2-2, and 2-6 (FIG. 31A) and variants 1-12, 1-42, 1-20, and 1-19 (FIG. 31B).
Figure 31B:
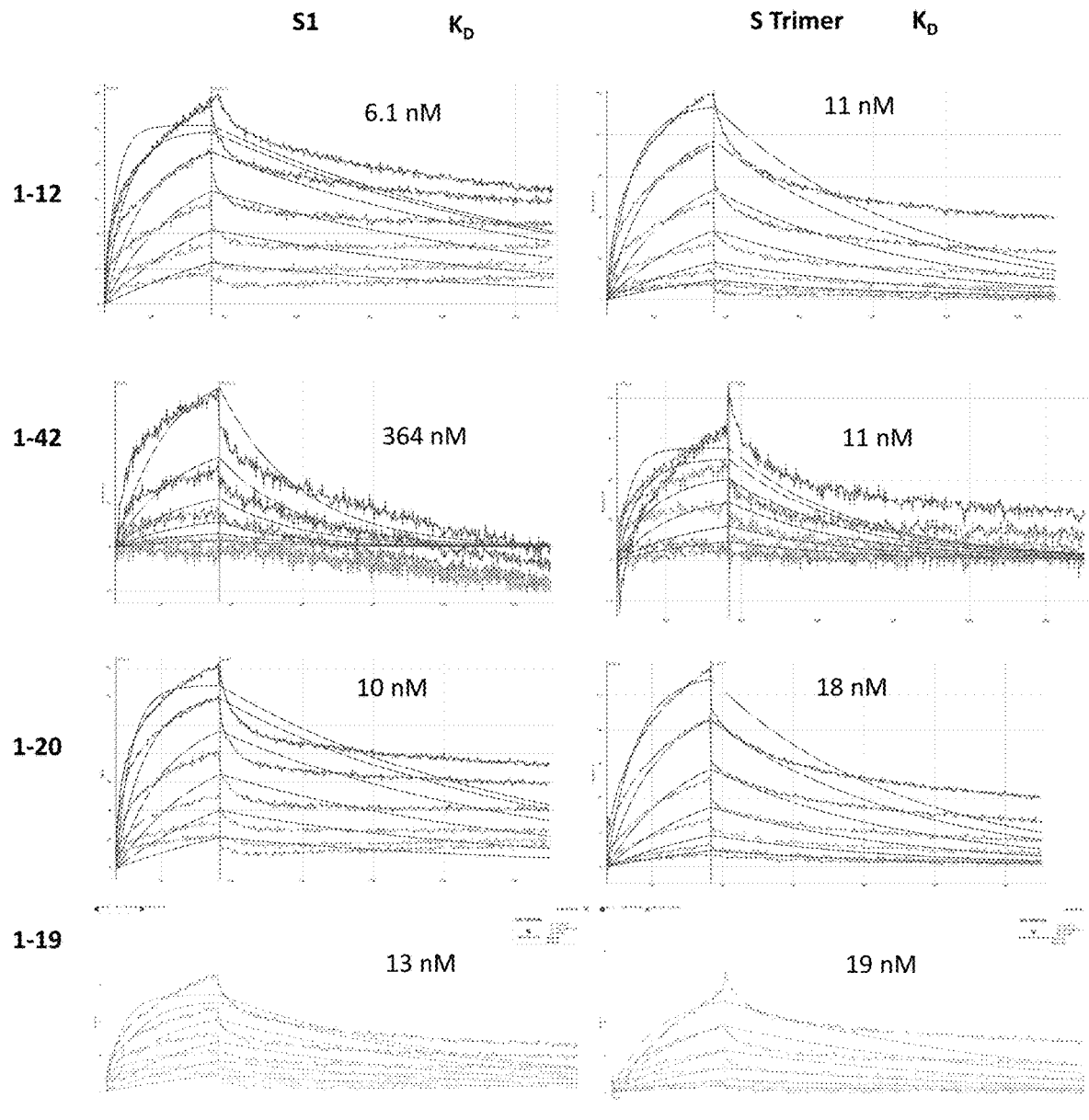
Figure 31C:
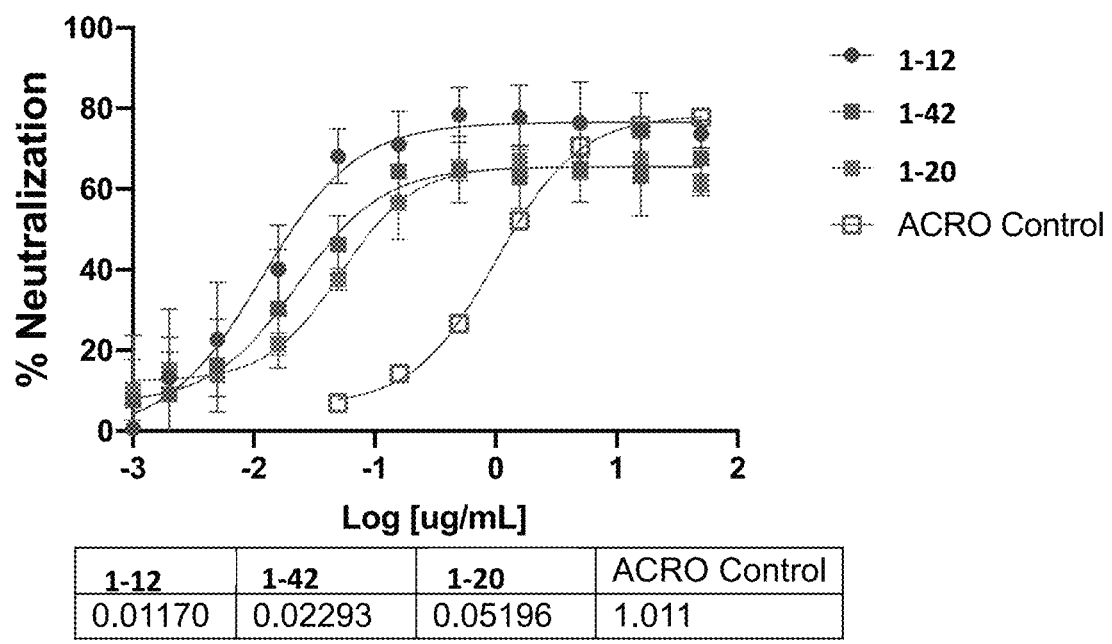
FIG. 31C is a graph of percent neutralization for variants 1-12, 1-42 and 1-20.
Figure 31D:
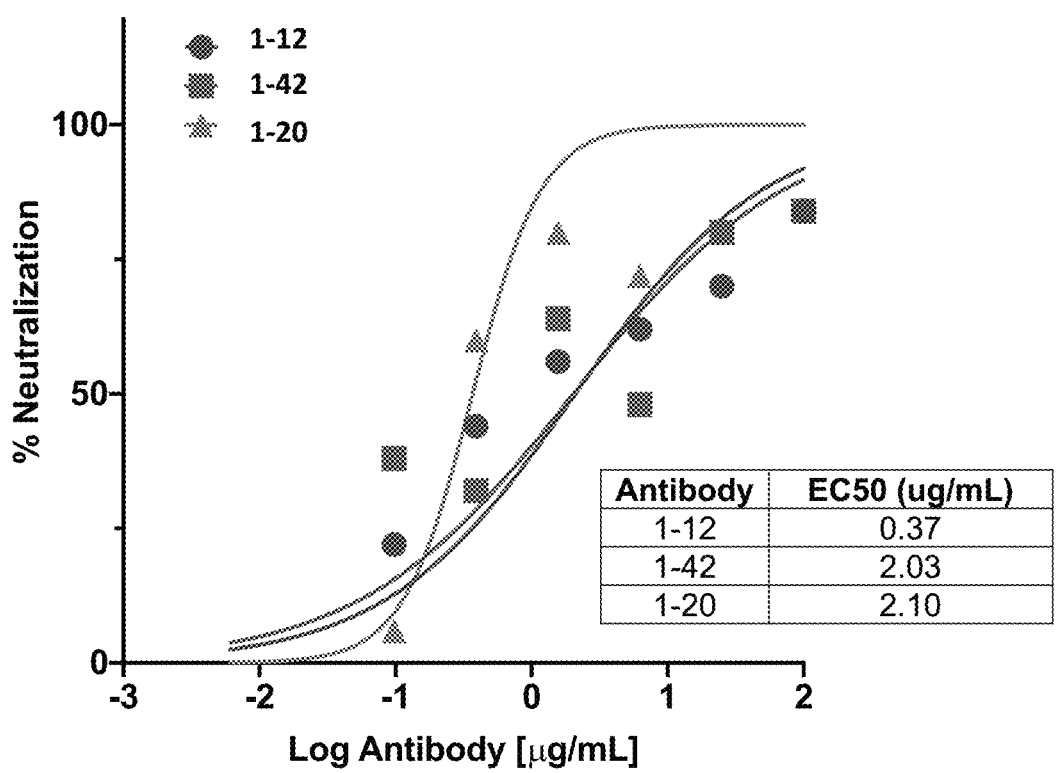
FIG. 31D is a graph of percent neutralization for variants 1-12, 1-42 and 1-20 using live virus.

SARS-CoV-2 variants were tested for specificity using a phage ELISA as described above. The antigens used included Acro SARS-CoV-2 (COVID-19) S1 protein and CV S-protein construct 6 trimer TP31001F. the antigens were coated at 1 ug/mL, 20 uL per well in 384 NUNC plate. Purified antibodies were prepared in in PBS-Tween at 100 nM, 10 nM, 1 nM, 0.1 nM. Secondary detection was performed using MonoRab™ Rabbit Anti-Camelid VHH Antibody [HRP], mAb (GenScript cat #A01860-200) used at 1:10,000. Data from the phage ELISA is seen in FIGS. 25A-25H for antibody 5 variants and FIGS. 26A-26I for antibody 6 variants. FIGS. 27A-27B show ELISA data for select antibody 6 variants. FIGS. 28A-28F shows phage ELISA for antibody 5 variants using 1 nM and 0.1 nM concentrations of antibodies. FIGS. 29A-29J shows phage ELISA for antibody 6 variants using 1 nM and 0.1 nM concentrations of antibodies. The SARS-CoV-2 variant antibodies were also assayed for affinity. Direct coupling refers to direct amine coupling of the antibody to the chip surface for the SPR assays. Tables 12-13 show SPR data for antibody 5 variants and antibody 6 variants.

TABLE 12

| New Name | S1 $K_D$ (nM) | S Trimer $K_D$ (nM) | Competition Factor |
|---|---|---|---|
| 5-1 | 15.1 | 0.4 | 10.01 |
| 5-2 | 54.2 | 1.5 | 2.29 |
| 5-3 | 64.6 | 5.6 | 0.87 |
| 5-4 | — | — | 0.83 |
| 5-5 | 61.9 | 4.0 | 6.55 |

TABLE 12-continued

| New Name | S1 $K_D$ (nM) | S Trimer $K_D$ (nM) | Competition Factor |
|---|---|---|---|
| 5-6 | 29.1 | 0.3 | 2.58 |
| 5-7 | — | — | 3.43 |
| 5-8 | 62.2 | 3.8 | 7.11 |
| 5-9 | 40.6 | 0.7 | 3.27 |
| 5-10 | 588.0 | 5.4 | 0.90 |
| 5-11 | — | 0.0 | 4.79 |
| 5-12 | 96.6 | 4.8 | 2.55 |
| 5-13 | 37.5 | 3.8 | 1.97 |
| 5-14 | — | — | 0.84 |
| 5-15 | 96.2 | 2.3 | 6.22 |
| 5-16 | 50.2 | 1.9 | 1.39 |
| 5-17 | 3628.8 | 18.9 | 0.88 |
| 5-18 | — | — | 0.80 |
| 5-19 | 80.1 | 0.1 | 4.56 |
| 5-20 | 14.3 | 1.1 | 12.44 |
| 5-21 | 1069.3 | 10.0 | 1.14 |
| 5-22 | 108.7 | 7.2 | 2.06 |
| 5-23 | 84.8 | 4.2 | 0.95 |
| 5-24 | 34.6 | 2.2 | 4.90 |
| 5-25 | 43.3 | 20.1 | 0.82 |
| 5-26 | 21846.3 | — | 0.81 |
| 5-27 | 92.9 | 109.8 | 0.93 |
| 5-28 | 40.0 | 1.0 | 3.61 |
| 5-29 | 42.4 | 1.0 | 7.08 |
| 5-30 | 53.1 | 1.8 | 2.04 |
| 5-31 | — | — | 0.78 |
| 5-32 | 22.4 | 0.1 | 0.79 |
| 5-33 | 38.0 | 0.2 | 0.84 |
| 5-34 | — | — | 5.69 |
| 5-35 | — | 16.0 | 0.78 |
| 5-36 | — | — | 0.83 |
| 5-37 | 30.2 | 1.8 | 8.19 |
| 5-38 | 28.5 | 0.7 | 8.41 |

TABLE 12-continued

| New Name | S1 $K_D$ (nM) | S Trimer $K_D$ (nM) | Competition Factor |
|---|---|---|---|
| 5-39 | 117.5 | 37.6 | 1.11 |
| 5-40 | — | — | 0.86 |
| 5-41 | 243.8 | 4.1 | 3.64 |
| 5-42 | 115.9 | 0.6 | 0.91 |
| 5-43 | — | — | 0.89 |
| 5-44 | 59.2 | 2.4 | 6.02 |
| 5-45 | — | — | 0.96 |
| 5-46 | 255.7 | 7.2 | 10.49 |
| 5-47 | 27.7 | 0.7 | 11.67 |
| 5-48 | — | — | 0.83 |
| 5-49 | 74.5 | 3.4 | 5.01 |
| 5-50 | 60.5 | 3.8 | 5.09 |
| 5-51 | 25.5 | 0.0 | 1.03 |
| 5-52 | 99.0 | 0.9 | 2.86 |
| 5-53 | — | 683.6 | 0.83 |
| 5-54 | — | — | 0.79 |
| 5-55 | 63.5 | 0.6 | 6.86 |
| 5-56 | 54.3 | 2.8 | 5.36 |
| 5-57 | — | 37.0 | 0.83 |
| 5-58 | 1679.6 | 3.5 | 0.93 |
| 5-59 | 113.3 | 6.4 | 4.55 |
| 5-60 | 29.4 | 0.8 | 7.85 |
| 5-61 | — | — | 0.82 |
| 5-62 | — | — | 0.84 |
| 5-63 | 10.5 | 0.4 | 1.62 |
| 5-64 | 346.5 | 221.2 | 0.84 |
| 5-65 | 352.7 | 421.0 | 0.94 |
| 5-66 | — | 98.9 | 1.00 |
| 5-67 | 22.1 | 1.0 | 10.95 |
| 5-68 | 111.0 | 4.8 | 4.58 |
| 6-1 | 35.8 | 1.2 | 5.38 |
| 6-2 | 29.9 | 1.2 | 3.14 |
| 6-3 | 12.4 | 0.0 | 9.51 |
| 6-4 | 45.8 | 0.5 | 2.71 |
| 6-5 | 24.9 | 0.8 | 4.33 |
| 6-6 | 6.4 | 67.7 | 0.97 |
| 6-7 | — | — | 8.73 |
| 6-8 | 69.4 | 4.6 | 4.06 |
| 6-9 | 18.5 | 0.9 | 4.17 |
| 6-10 | 29.7 | 0.6 | 6.92 |
| 6-11 | — | — | 4.26 |
| 6-12 | 50.2 | 1.4 | 2.56 |
| 6-13 | 25.3 | 0.6 | 3.20 |
| 6-14 | 134.7 | 465.9 | 0.83 |
| 6-15 | — | 9054.3 | 1.06 |
| 6-16 | 52.1 | 2.2 | 2.32 |
| 6-17 | 65.2 | 0.6 | 3.04 |
| 6-18 | 30.1 | 5.3 | 5.87 |
| 6-19 | 71.0 | 1.0 | 0.93 |
| 6-20 | 20.9 | 0.3 | 9.95 |
| 6-21 | — | — | 0.83 |
| 6-22 | 25.6 | 1.8 | 2.35 |
| 6-23 | 59.3 | 0.3 | 4.30 |
| 6-24 | 29.9 | 0.2 | 1.26 |
| 6-25 | 248.0 | 5.8 | 0.80 |
| 6-26 | 38.7 | 0.1 | 6.41 |
| 6-27 | — | — | 0.85 |
| 6-28 | 54.1 | 0.4 | 4.64 |
| 6-29 | 97.5 | 1.6 | 2.87 |
| 6-30 | 11.8 | 0.1 | 10.51 |
| 6-31 | 39.6 | 20.7 | 0.92 |
| 6-32 | 27.2 | 0.1 | 1.43 |
| 6-33 | 76.4 | 0.2 | 2.88 |
| 6-34 | 21.3 | 0.7 | 5.22 |
| 6-35 | 251.1 | — | 0.94 |
| 6-36 | 32.1 | 0.8 | 4.40 |
| 6-37 | 22.5 | 0.7 | 4.77 |
| 6-38 | 26.6 | 0.5 | 5.68 |
| 6-39 | 11.3 | 0.1 | 7.26 |
| 6-40 | 44.3 | 1.9 | 7.20 |
| 6-41 | 51.5 | 1.0 | 7.27 |
| 6-42 | 10.1 | 7.8 | 1.12 |
| 6-43 | 17.9 | 0.7 | 4.07 |
| 6-44 | 8.2 | 0.9 | 6.10 |
| 6-45 | 17.5 | 1.3 | 5.14 |
| 6-46 | 18.1 | 1.9 | 4.88 |
| 6-47 | 43.9 | 5.6 | 6.26 |
| 6-48 | — | — | 0.93 |
| 6-49 | 58.2 | 2.2 | 1.07 |
| 6-50 | — | 67.6 | 1.05 |
| 6-51 | 35.2 | 0.8 | 0.82 |
| 6-52 | 31.2 | 1.1 | 2.77 |
| 6-53 | 139.7 | 24.2 | 0.88 |
| 6-54 | 143.7 | 0.9 | 6.84 |
| 6-55 | 25.2 | 0.3 | 7.98 |
| 6-56 | — | 14.9 | 3.31 |
| 6-57 | 205.3 | 0.7 | 6.63 |
| 6-58 | 20.7 | 1.0 | 2.96 |
| 6-59 | — | 27.6 | 2.21 |
| 6-60 | 20.1 | 0.1 | 12.61 |
| 6-61 | — | — | 2.60 |
| 6-62 | 151.4 | 198.1 | 4.89 |
| 6-63 | 21.8 | 0.3 | 7.76 |
| 6-64 | — | 20.1 | 0.89 |
| 6-65 | 889.8 | — | 9.47 |
| 6-66 | 293.1 | 7.7 | 2.45 |
| 6-67 | 55.6 | 0.1 | 6.01 |
| 6-68 | 101.5 | 0.7 | 2.32 |
| 6-69 | — | — | 0.82 |
| 6-70 | 35.9 | 1.1 | 1.41 |
| 6-71 | 155.2 | 0.6 | 2.77 |
| 6-72 | 92.8 | 2.0 | 2.08 |
| 6-73 | 103.2 | 0.5 | 7.99 |
| 6-74 | 73.9 | 498.2 | 0.90 |
| 6-75 | 181.0 | 1.0 | 3.56 |
| 6-76 | 33.5 | 1.8 | 9.96 |
| 6-77 | 24.6 | 3.5 | 6.84 |
| 6-78 | 18.9 | 0.4 | 9.27 |
| 6-79 | 157.8 | 0.0 | 0.78 |
| 6-80 | 33.7 | 0.8 | 3.04 |
| 6-81 | 12.9 | 3.9 | 11.92 |
| 6-82 | 7.1 | 0.6 | 1.35 |
| 6-83 | 163.2 | 4.4 | 4.09 |
| 6-84 | 82.6 | 0.7 | 0.89 |
| 6-85 | 15.0 | 0.5 | 6.47 |
| 6-86 | 25.0 | 0.9 | 3.07 |
| 6-87 | 33.4 | 2.5 | 3.68 |
| 6-88 | 308.2 | 2.3 | 8.17 |
| 6-89 | — | — | 0.82 |
| 6-90 | 113.6 | 17.1 | 0.86 |
| 6-91 | 75.2 | 3.4 | 8.30 |
| 6-92 | 62.3 | 1.9 | 2.85 |
| 6-93 | 37.4 | 6.4 | 2.26 |
| 6-94 | 30.6 | 1.6 | 4.16 |
| 6-95 | — | 7.6 | 0.88 |
| 6-96 | 24.6 | 3.3 | 4.49 |
| 6-97 | 4070.9 | 57.9 | 1.26 |
| 6-98 | — | — | 0.87 |
| 6-99 | 51.6 | 3.4 | 1.74 |
| 6-100 | 7.0 | 0.6 | 10.79 |
| 6-101 | — | — | 0.90 |
| 6-102 | 45.7 | 0.9 | 0.90 |
| 6-103 | 23.6 | 1.0 | 1.41 |
| 6-104 | — | — | 0.97 |
| 6-105 | 41.6 | 1.9 | 5.64 |
| 6-106 | — | 1072.2 | 0.94 |
| 6-107 | 24.1 | 0.5 | 3.20 |
| 6-108 | 69.4 | 0.3 | 0.99 |
| 6-109 | 48.7 | 12.2 | 10.03 |
| 6-110 | 15.6 | 0.3 | 4.59 |
| 6-111 | 98.6 | 4.4 | 4.23 |
| 6-112 | 3229.9 | 43.8 | 0.90 |

TABLE 13

| VHH-Fc | S1 $K_D$ (nM) | S Trimer $K_D$ (nM) | MFI Fold Decrease |
|---|---|---|---|
| 6-6 | 6.4 | 67.70 | 0.97 |
| 6-100 | 7 | 0.60 | 10.79 |
| 6-82 | 7.1 | 0.60 | 1.35 |

TABLE 13-continued

| VHH-Fc | S1 $K_D$ (nM) | S Trimer $K_D$ (nM) | MFI Fold Decrease |
|---|---|---|---|
| 6-44 | 8.2 | 0.90 | 6.1 |
| 6-42 | 10.1 | 7.80 | 1.12 |
| 5-63 | 10.5 | 0.40 | 1.62 |
| 6-39 | 11.3 | 0.10 | 7.26 |
| 6-30 | 11.8 | 0.10 | 10.51 |
| 6-3 | 12.4 | 0.00 | 9.51 |
| 6-81 | 12.9 | 3.90 | 11.92 |
| 5-20 | 14.3 | 1.10 | 12.44 |
| 6-85 | 15 | 0.50 | 6.47 |
| 5-1 | 15.1 | 0.40 | 10.01 |
| 6-110 | 15.6 | 0.30 | 4.59 |
| 6-45 | 17.5 | 1.30 | 5.14 |
| 6-43 | 17.9 | 0.70 | 4.07 |
| 6-46 | 18.1 | 1.90 | 4.88 |
| 6-9 | 18.5 | 0.90 | 4.17 |
| 6-78 | 18.9 | 0.40 | 9.27 |
| 6-60 | 20.1 | 0.10 | 12.61 |
| 6-58 | 20.7 | 1.00 | 2.96 |
| 6-20 | 20.9 | 0.30 | 9.95 |
| 6-34 | 21.3 | 0.70 | 5.22 |
| 6-63 | 21.8 | 0.30 | 7.76 |
| 5-67 | 22.1 | 1.00 | 10.95 |
| 5-32 | 22.4 | 0.10 | 0.79 |
| 6-37 | 22.5 | 0.70 | 4.77 |
| 6-103 | 23.6 | 1.00 | 1.41 |
| 6-107 | 24.1 | 0.50 | 3.2 |
| 6-96 | 24.6 | 3.30 | 4.49 |
| 6-77 | 24.6 | 3.50 | 6.84 |
| 6-5 | 24.9 | 0.80 | 4.33 |
| 6-86 | 25 | 0.90 | 3.07 |
| 6-55 | 25.2 | 0.30 | 7.98 |
| 6-13 | 25.3 | 0.60 | 3.2 |
| 5-51 | 25.5 | 0.00 | 1.03 |
| 6-22 | 25.6 | 1.80 | 2.35 |
| 6-38 | 26.6 | 0.50 | 5.68 |
| 6-32 | 27.2 | 0.10 | 1.43 |
| 5-47 | 27.7 | 0.70 | 11.67 |
| 5-38 | 28.5 | 0.70 | 8.41 |
| 5-6 | 29.1 | 0.30 | 2.58 |
| 5-60 | 29.4 | 0.80 | 7.85 |
| 6-10 | 29.7 | 0.60 | 6.92 |
| 6-2 | 29.9 | 1.20 | 3.14 |
| 6-24 | 29.9 | 0.20 | 1.26 |
| 6-18 | 30.1 | 5.30 | 5.87 |
| 5-37 | 30.2 | 1.80 | 8.19 |
| 6-94 | 30.6 | 1.60 | 4.16 |
| 6-52 | 31.2 | 1.10 | 2.77 |
| 5-56 | 54.3 | 2.77 | 5.36 |
| 5-8 | 62.2 | 3.80 | 7.11 |
| 6-91 | 75.2 | 3.45 | 8.30 |
| 6-73 | 103.2 | 0.52 | 7.99 |
| 5-34 | — | — | 5.69 |
| 6-26 | 38.7 | 0.07 | 6.41 |
| 6-76 | 33.5 | 1.77 | 9.96 |

Figure 32:
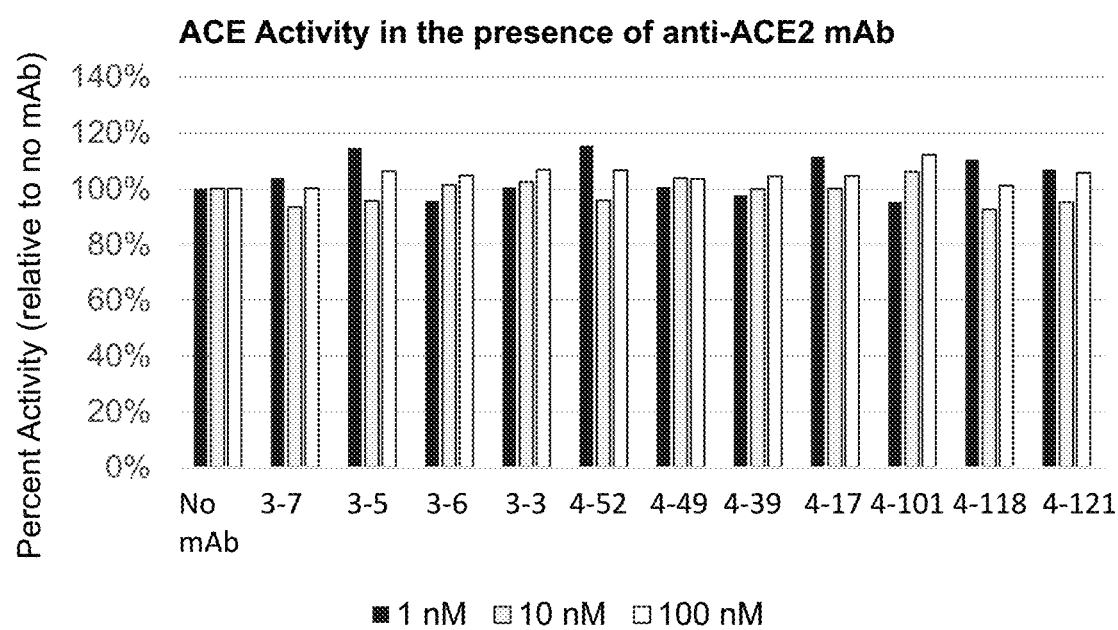
FIG. 32 is a graph of ACE Activity in the presence of variant ACE2 antibodies.

VHH-Fc antibodies targeting S1 were titrated 1:3 starting at 200 nM and mixed 1:1 with SARS-COV2-S1 RBD (mouse IgG2Fc tag). The RBD/VHH-Fc complex was added to Vero E6 cells expressing endogenous ACE2 receptor and incubated. Cells were subsequently washed and an anti-mouse secondary was used to measure binding of S1 RBD to ACE2, thus assessing the inhibition of S1. Over 60 clones demonstrated potent inhibition. Data is seen in FIGS. 30A-30C and Tables 14A-14B.

TABLE 14A

| Sample | $IC_{50}$ [nM] |
|---|---|
| 2-2 | 0.56 |
| 5-56 | 0.68 |
| 5-1 | 0.75 |
| 5-67 | 0.76 |
| 5-47 | 0.80 |
| 5-8 | 0.94 |
| 5-38 | 0.96 |
| 5-37 | 1.01 |
| 5-34 | 1.21 |
| 5-20 | 1.23 |
| 5-55 | 1.45 |
| 5-46 | 1.52 |
| 5-50 | 1.61 |
| 5-5 | 1.79 |
| 2-5 | 2.146 |
| 5-60 | 2.15 |
| 5-15 | 2.19 |
| 5-29 | 2.19 |
| Acro Anti S1 | 3.80 |
| 5-49 | 5.61 |
| 5-44 | 11.73 |

TABLE 14B

| Sample | $IC_{50}$ [nM] |
|---|---|
| 6-85 | 0.2044 |
| 2-2 | 0.56 |
| 6-63 | 0.74 |
| 6-3 | 0.74 |
| 6-78 | 0.7427 |
| 6-20 | 0.76 |
| 6-91 | 0.89 |
| 6-44 | 0.97 |
| 6-55 | 0.97 |
| 6-73 | 1.01 |
| 6-26 | 1.07 |
| 6-76 | 1.11 |
| 6-45 | 1.16 |
| 6-60 | 1.31 |
| 6-40 | 1.36 |
| 6-81 | 1.383 |
| 6-10 | 1.44 |
| 6-7 | 1.53 |
| 6-39 | 1.53 |
| 6-109 | 1.60 |
| 6-38 | 1.94 |
| 2-5 | 2.146 |
| 6-30 | 2.94 |
| 6-57 | 3.13 |
| Acro Anti S1 | 3.49 |
| 6-67 | 3.80 |
| 6-77 | 4.041 |
| 6-100 | 5.07 |
| 6-47 | 5.86 |
| 6-41 | 6.60 |
| 6-88 | 7.118 |
| 6-105 | 7.82 |
| 6-34 | 8.24 |
| 6-54 | 8.90 |
| 6-18 | 12.29 |
| 6-1 | 15.76 |
| 6-65 | 37.47 |

Antibody kinetics were measured for variants 2-5, 2-2, and 2-6 (FIG. 31A) and variants 1-12, 1-42, 1-20, and 1-19 (FIG. 31B). Data is seen in FIGS. 31A-31B. The data shows that the antibodies bind with nanomolar affinities. FIG. 31C shows percent neutralization for variants 1-12, 1-42 and 1-20. FIG. 31D shows percent neutralization for variants 1-12, 1-42 and 1-20 using live virus.

The ACE2 variant antibodies were measured for effects on ACE activity. Using a Sigma-Aldrich ACE activity assay kit (CS0002), ACE positive control were premixed with 1, 10, 100 nM anti-ACE2 mAb and read at 320 nm excitation, 405 nm emission, 5 min kinetics. The data is seen in FIG. 32 and shows the ACE2 variant antibodies do not inhibit enzyme activity.

Example 7. Neutralization of Live Virus

Figure 33A:
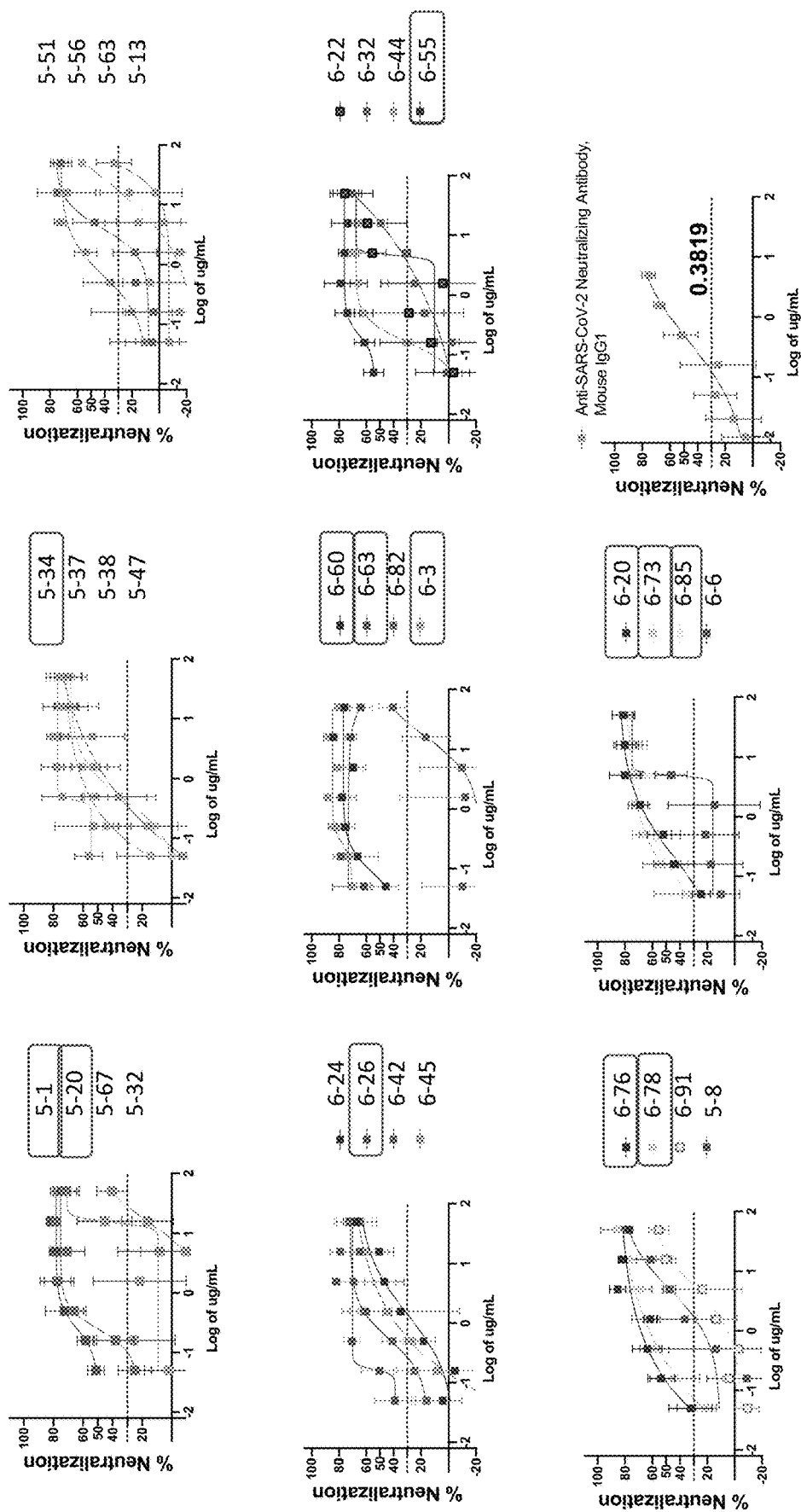

VHH-Fc antibodies targeting S1 were titrated 1:3 starting at 200 nM and mixed 1:1 with SARS-COV2-S1 RBD (mouse IgG2Fc tag). The RBD/VHH-Fc complex was added to Vero E6 cells expressing endogenous ACE2 receptor and incubated. Cells were subsequently washed and an anti-mouse secondary was used to measure binding of S1 RBD to ACE2, thus assessing the inhibition of S1. Over 60 clones demonstrated potent inhibition. The data is seen in FIGS. 33A-33B and Table 15A.

TABLE 15A

| Antibody | EC50 (ug/mL) |
|---|---|
| 6-63 | 0.06 |
| 6-3 | 0.06 |
| 2165 mAb* | 0.08 |
| 5-1 | 0.10 |
| 6-60 | 0.15 |
| 6-55 | 0.21 |
| 5-20 | 0.27 |
| 1-20 | 0.37 |
| 5-34 | 0.54 |
| 6-85 | 0.84 |
| 6-76 | 1.08 |
| 6-73 | 1.46 |
| 1-42 | 2.03 |
| 1-12 | 2.10 |
| 6-26 | 2.97 |
| 6-20 | 5.03 |
| 6-78 | 8.26 |
| 2-6 | 11.77 |
| 2-5 | 18.31 |
| 2-2 | 67.57 |
| 1-63 | 106.90 |

Figure 33B:
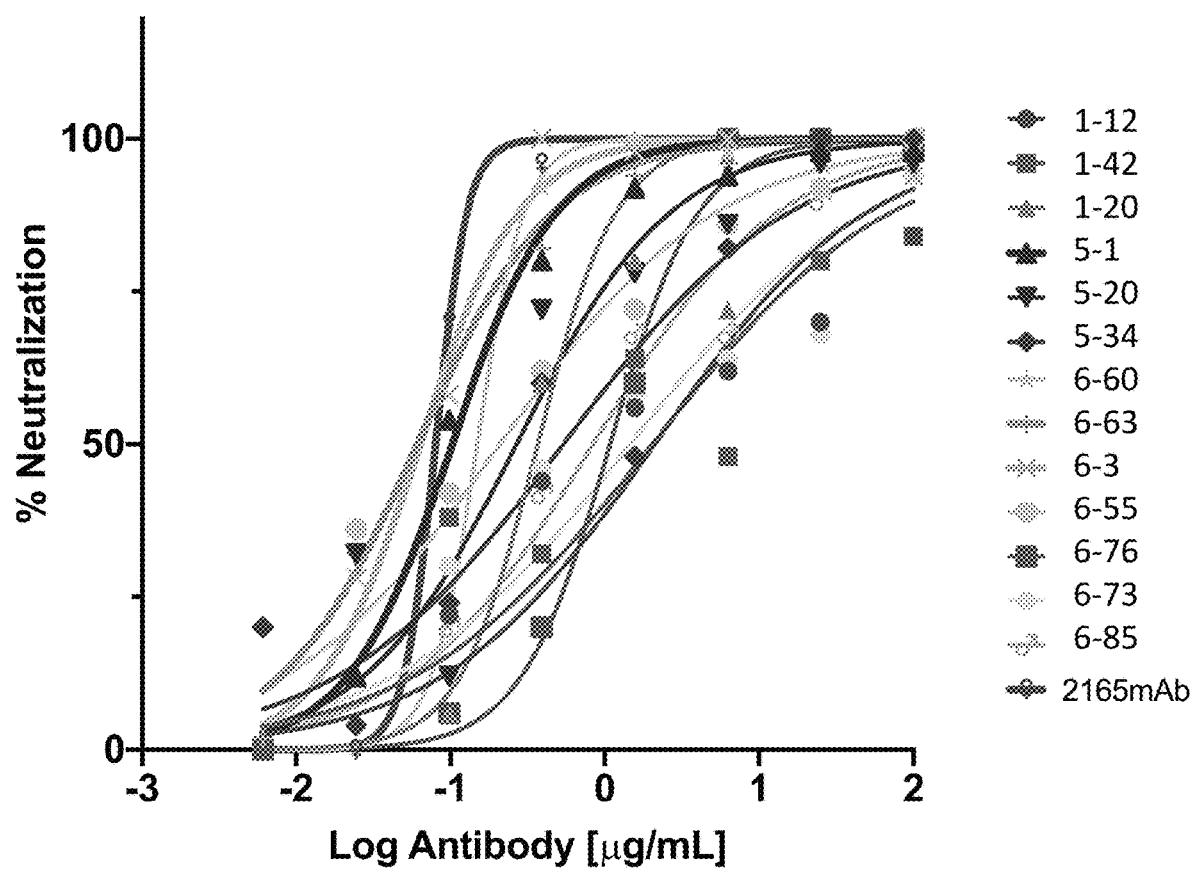

FIG. 33B shows that variant 6-2 showed higher neutralization versus IgG in live virus. Variants 6-63, 6-3, and 5-1 showed comparable neutralization versus 2165 mAb derived from a COVID-19 subject.

Figure 33E:
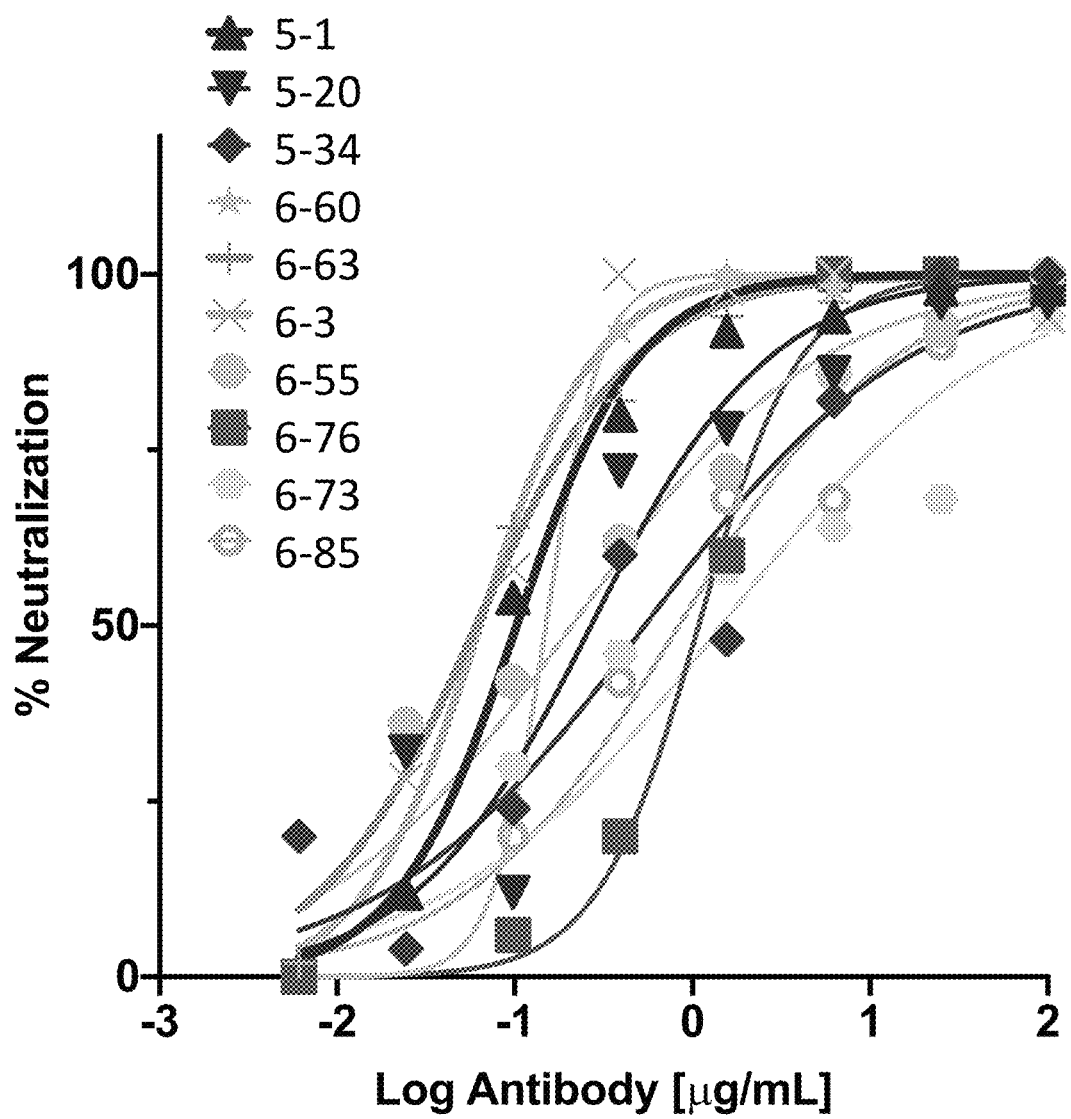
FIG. 33E is a graph of variant antibodies neutralizing live virus FRNT.
Figure 33F:
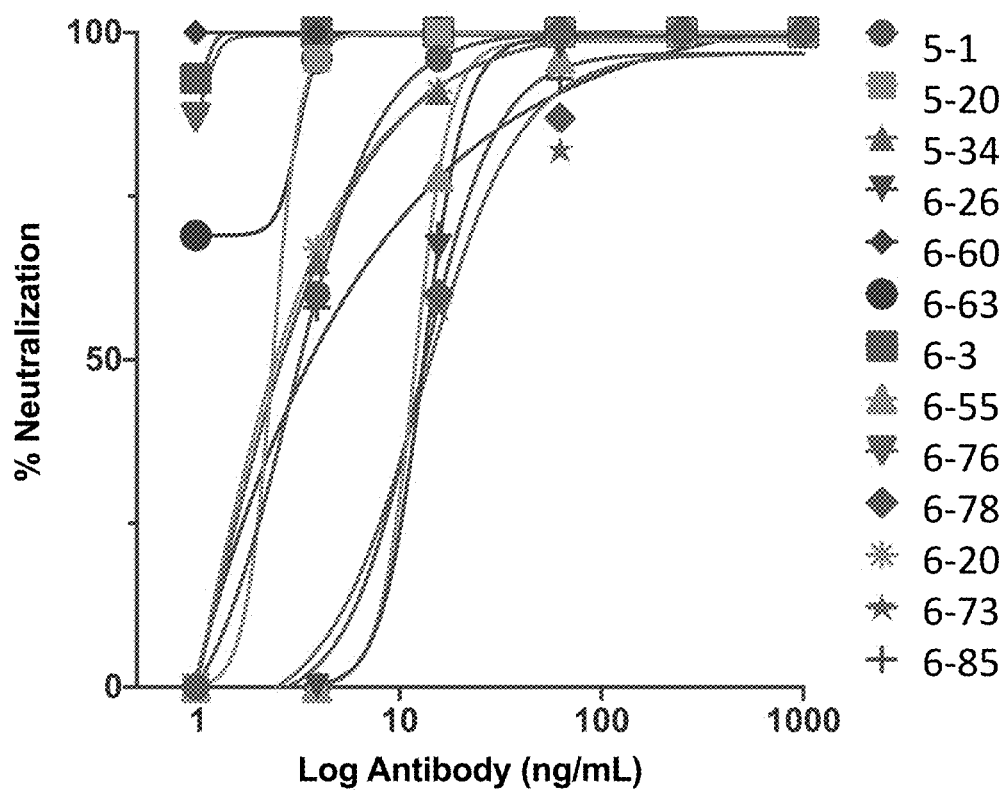
FIGS. 33F-33I show data of variant antibodies neutralizing live virus PRNT.
Figure 33G:
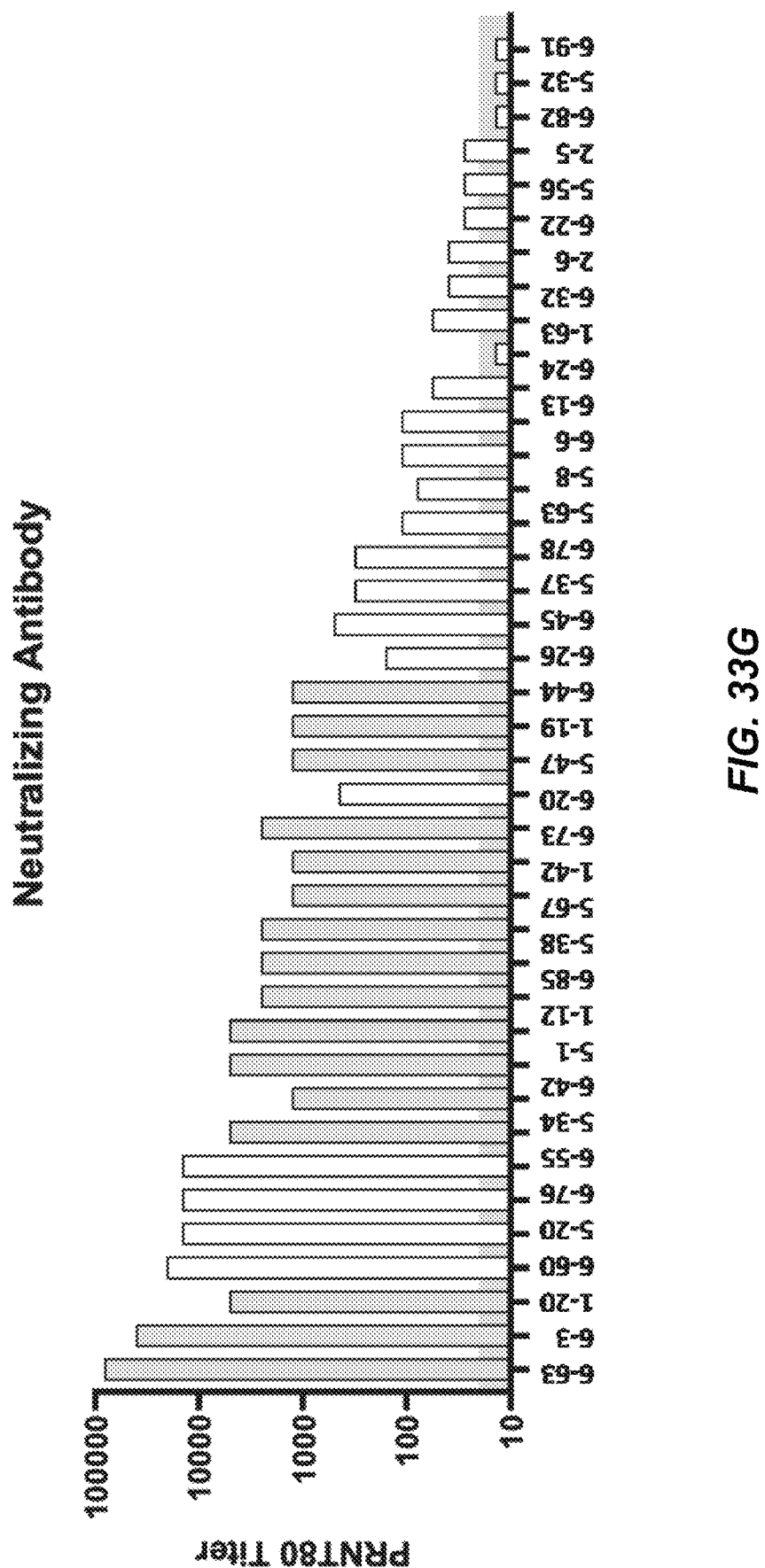
Figure 33H:
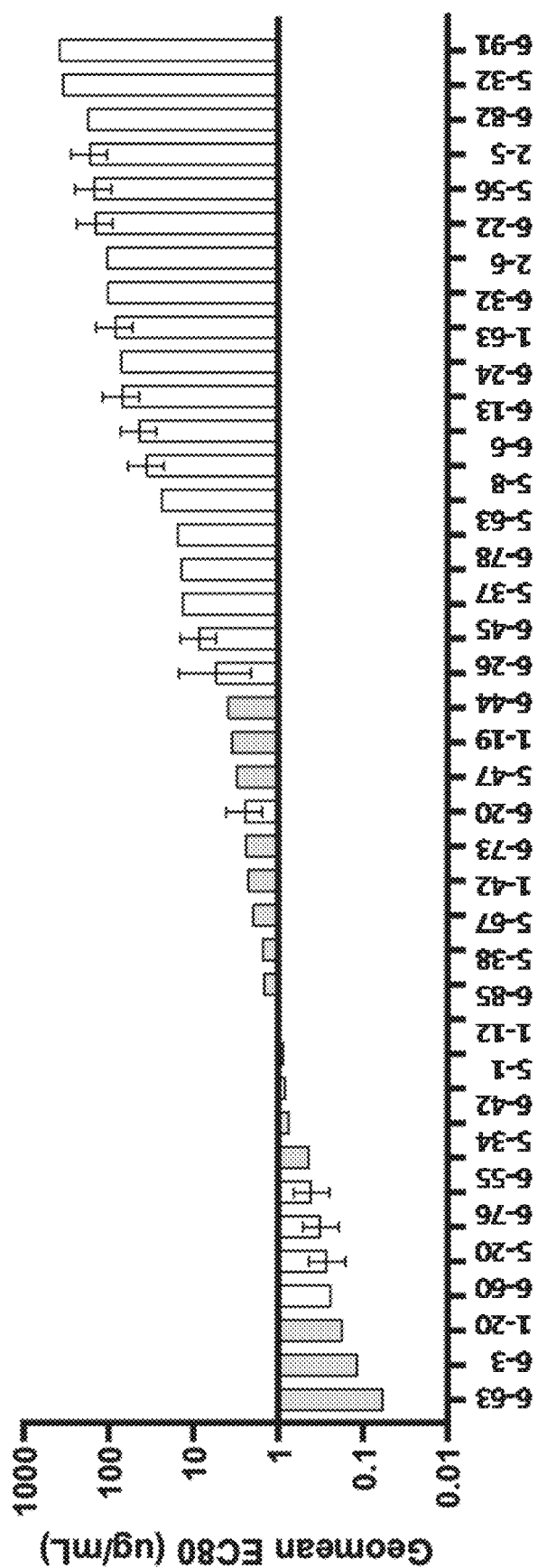

FIGS. 33C-33E and Table 15B show data from VHH single domain antibodies in VSV-pseudotype SARS-CoV-2 neutralization assays. Variants 5-1, 6-3, and 6-63 showed improved neutralization in pseudovirus testing including in live virus FRNT (FIG. 33E). Variants 6-3, 6-60, 6-63, and 6-76 showed potent neutralization in live virus PRNT as seen in Table 15C and FIG. 33F. Data as seen in Table 15D and FIGS. 33G-33H show that variants 6-3, 6-63, and 1-20 exhibited potent neutralization in live virus PRNT.

TABLE 15B

| Antibody | NC50 (ug/mL) |
|---|---|
| 6-63 | 0.06 |
| 6-3 | 0.06 |
| 5-1 | 0.10 |
| 6-60 | 0.15 |
| 6-55 | 0.21 |
| 5-20 | 0.27 |
| 1-20 | 0.37 |
| 5-34 | 0.54 |
| 6-85 | 0.84 |
| 6-76 | 1.08 |
| 6-73 | 1.46 |
| 1-42 | 2.03 |
| 1-12 | 2.10 |

TABLE 15B-continued

| Antibody | NC50 (ug/mL) |
|---|---|
| 6-26 | 2.97 |
| 6-20 | 5.03 |
| 6-78 | 8.26 |
| 2-6 | 11.77 |
| 2-5 | 18.31 |
| 2-2 | 67.57 |
| 1-63 | 106.90 |

TABLE 15C

| Antibody | PRNT90 (ng/mL) |
|---|---|
| 5-1 | 15.6 |
| 5-20 | 3.9 |
| 5-34 | 15.6 |
| 6-26 | 62.5 |
| 6-60 | <0.98 |
| 6-63 | 3.9 |
| 6-3 | <0.98 |
| 6-55 | 62.5 |
| 6-76 | 3.9 |
| 6-78 | 250 |
| 6-20 | 15.6 |
| 6-73 | 250 |
| 6-85 | 62.5 |

TABLE 15D

| Antibody | EC80 (ug/mL) |
|---|---|
| 6-63 | 0.057861 |
| 6-3 | 0.115234 |
| 1-20 | 0.171875 |
| 6-60 | 0.236816 |
| 5-20 | 0.376 |
| 6-76 | 0.425781 |
| 6-55 | 0.445313 |
| 5-34 | 0.570313 |
| 6-42 | 0.734375 |
| 5-1 | 0.810547 |
| 1-12 | 0.855469 |
| 6-85 | 1.0625 |
| 5-38 | 1.5 |
| 5-67 | 1.566406 |
| 1-42 | 1.78125 |
| 6-73 | 2.015625 |
| 6-20 | 2.3125 |
| 5-47 | 2.457031 |
| 1-19 | 2.78125 |
| 6-44 | 3.15625 |
| 6-26 | 3.609375 |
| 6-45 | 4.015625 |
| 5-37 | 12.4375 |
| 6-78 | 13.75 |
| 5-63 | 14.1875 |
| 5-8 | 15.8125 |
| 6-6 | 24.375 |
| 6-13 | 25.6875 |
| 6-24 | 31.375 |
| 1-63 | 50.5 |
| 6-32 | 60.625 |
| 2-6 | 72.34043 |
| 6-22 | 103.25 |
| 5-56 | 104.75 |
| 2-5 | 106.5 |
| 6-82 | 107.75 |
| 5-32 | 180.1418 |
| 6-91 | 240.5 |
| 2-2 | 354.6099 |
| 5-51 | 387.9433 |

Figure 33I:
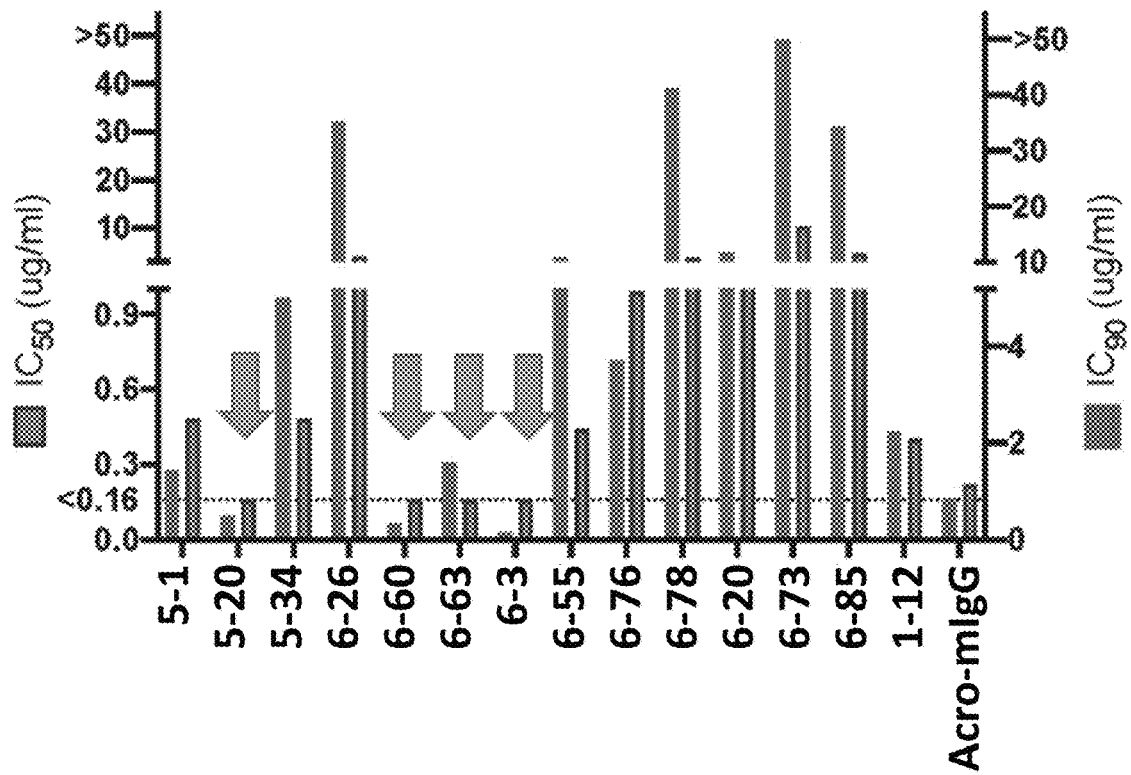

The variants were also tested in pseudovirus neutralization and live virus PRNT studies. Variants 5-20, 6-60, 6-63, and 6-3 showed potent neutralization in live virus PRNT as seen in FIG. 33I.

Example 8. In Vivo Evaluation of Variant Coronavirus Immunoglobulins

This Example assesses the variant coronavirus immunoglobulins in a Syrian hamster model (immunosuppressed) of COVID-19 disease.

8-10 week-old female Syrian hamsters were immunosuppressed using cyclophosphamide (140 mg/kg day 3 days before challenge and then 100 mg/kg every 4 days by i.p. route). Eleven groups of six hamsters per group were injected with antibody on day −1 relative to challenge by the intraperitoneal route (i.p.). On Day 0 all hamster were challenged with 1,000 PFU SARS CoV-2 Washington isolate by the intranasal route and weighed daily. % Weight change relative to starting weight was calculated. Pharyngeal swabs were collected on Days −1, 1, 4, 7, 9. Day 9 lungs were collected and homogenized for viral load. Groups are shown in Table 15E.

TABLE 15E

| Group | Diluent/volume injected i.p. |
|---|---|
| Groups | |
| Convalescent plasma | NA/2.5 mL |
| Negative control MAb c7d11 | PBS/2.5 mL |
| 6-63 | PBS/2.5 mL |
| 6-3 | PBS/2.5 mL |
| 6-36 | PBS/2.5 mL |

NA = not applicable

Figure 34A:
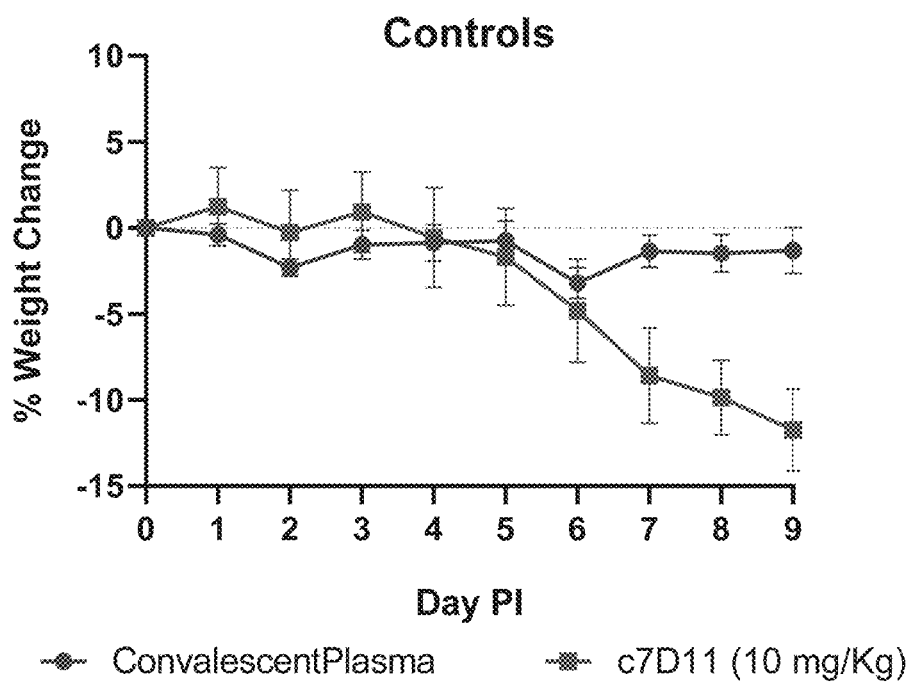
FIG. 34A shows a graph of percent weight change (y-axis) versus day post injection (PI, x-axis) for positive control convalescent plasma and negative control Mab c7d11.

Animals injected intraperitonealy (i.p.) with the Negative Control antibody lost weight starting losing significant amounts of weight between Days 5 and 6 and continued to decline until the end of the experiment on Day 9. The maximum mean weight loss of the group was −11.7%. In contrast, animals injected with positive control human convalescent plasma maintained weight within −3.2% of their weight on Day 0 indicating this plasma protected against disease manifested by weight loss (FIG. 34A).

Figure 34B:
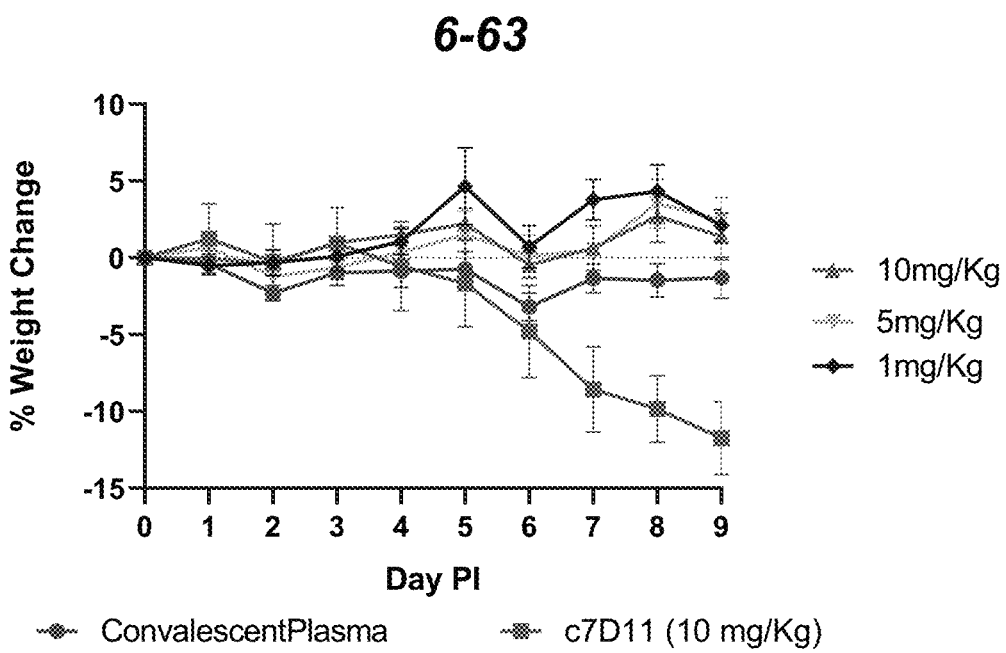
FIG. 34B shows a graph of percent weight change (y-axis) versus day post injection (PI, x-axis) for variant antibody 6-63.

Groups of six animals were injected i.p. with 10, 5, or 1 mg/kg of monoclonal antibody 6-63 diluted in PBS. All groups maintained their weight at or above starting weight indicating the antibody protected against disease resulting weight loss (FIG. 34B).

Figure 34C:
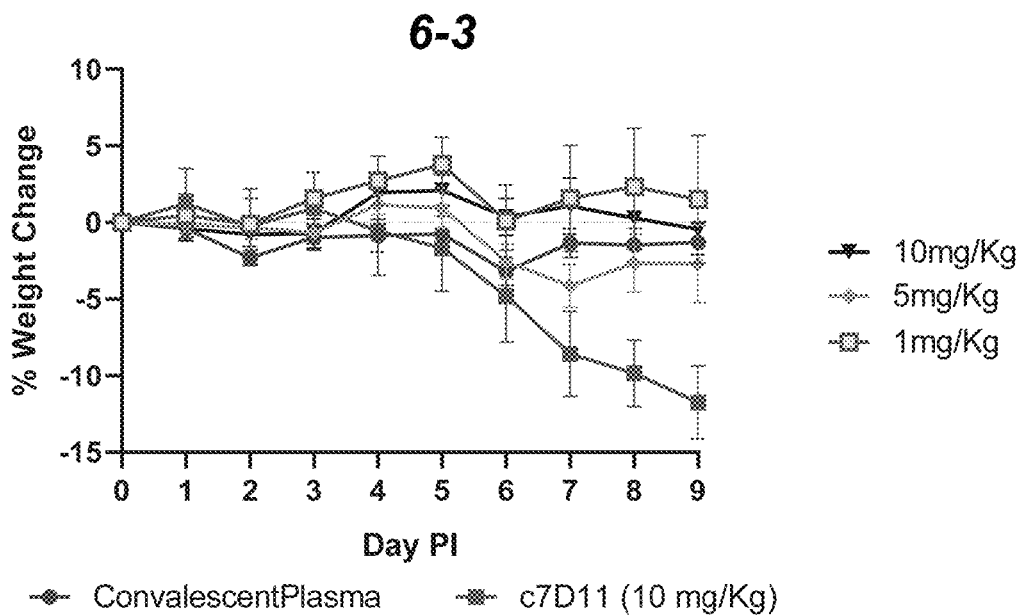
FIG. 34C shows a graph of percent weight change (y-axis) versus day post injection (PI, x-axis) for variant antibody 6-3.

Groups of six animals were injected i.p. with 10, 5, or 1 mg/kg of monoclonal antibody 6-3 diluted in PBS. The 1 and 10 mg/kg groups maintained their weight at or above starting weight at all time points. The 5 mg/kg group weight dipped slightly below the convalescent control on Days 7-9 but clearly was different from the Negative Control antibody. Together, these data indicate the antibody decreased weight loss associated with disease (FIG. 34C).

Figure 34D:
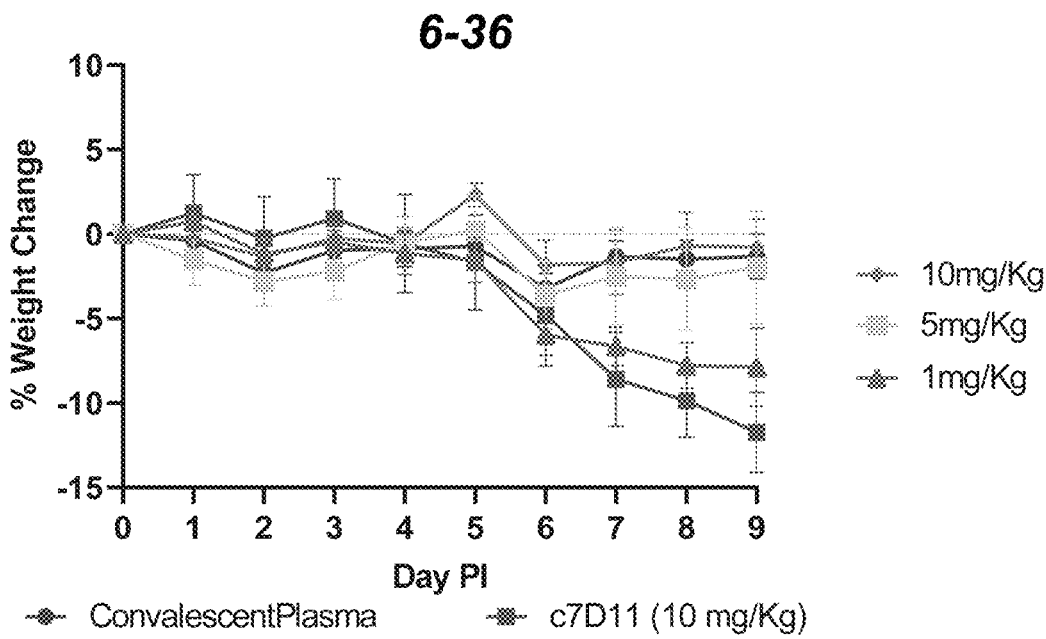
FIG. 34D shows a graph of percent weight change (y-axis) versus day post injection (PI, x-axis) for variant antibody 6-36.

Groups of six animals were injected i.p. with 10, 5, or 1 mg/kg of monoclonal antibody 6-36 diluted in PBS. The 10 and 5 mg/kg groups maintained their weight at levels similar to the positive control at all time points. The 1 mg/kg group weight dropped significantly similar to the Negative Control. These data indicate antibody 6-36 at 1 mg/kg is insufficient to provide benefit, but a 5-fold or greater dose is adequate to reduce disease as determined by weight loss (FIG. 34D).

Figure 34E:
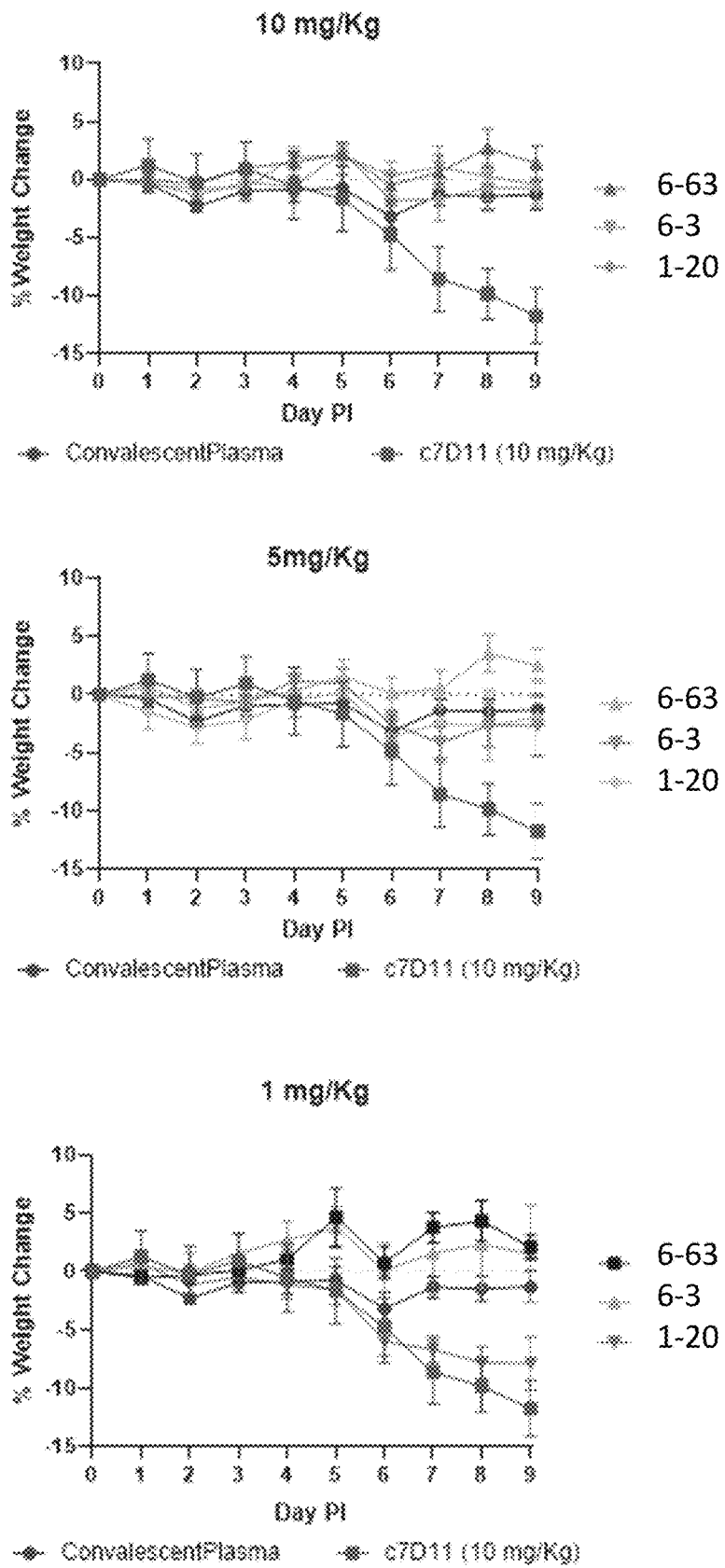
FIG. 34E shows graphs of percent weight change (y-axis) versus day post injection (PI, x-axis) based on dose.
Figure 34F:
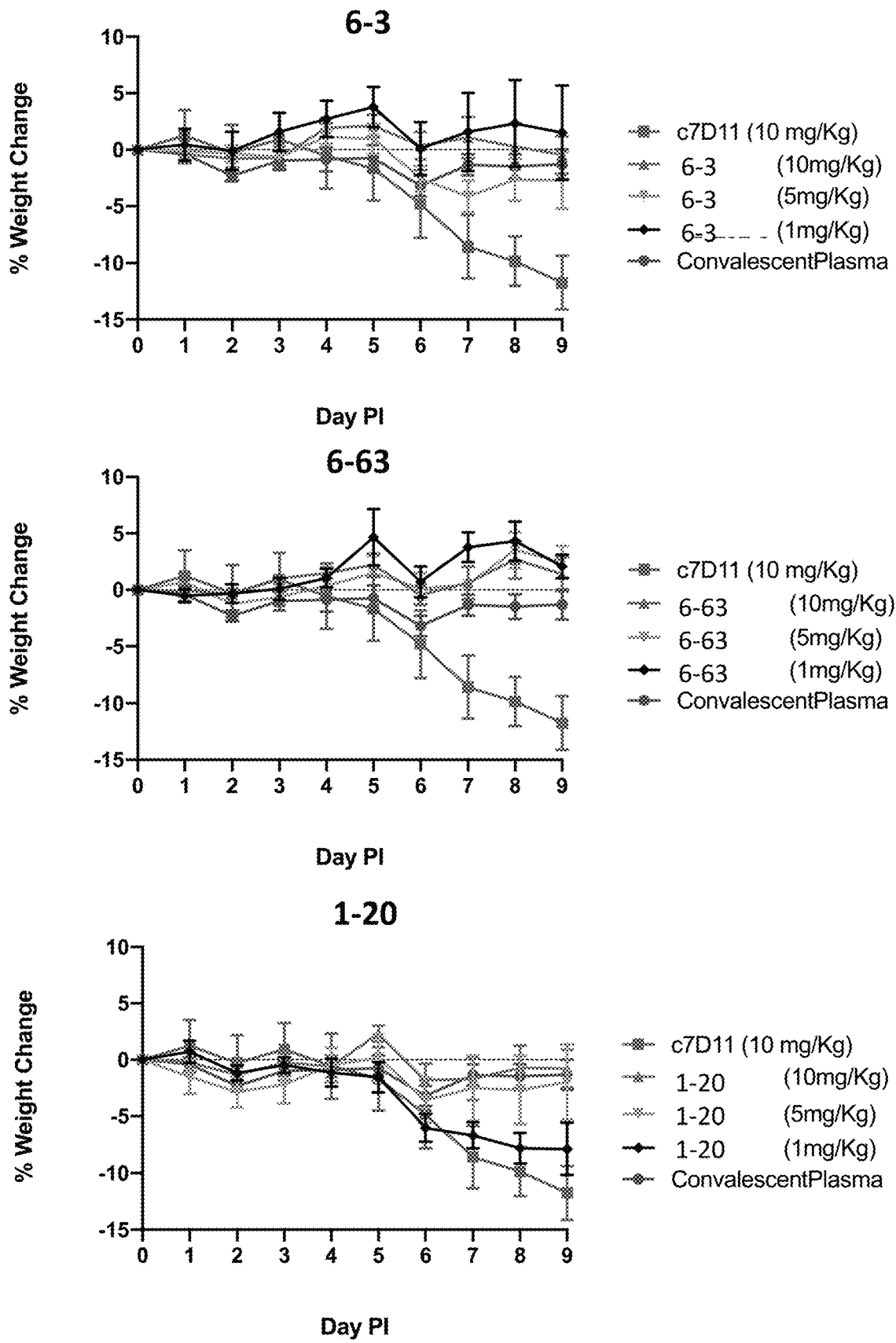
FIG. 34F shows graphs of percent weight change (y-axis) versus day post injection (PI, x-axis) based on dose for variant antibodies 2-3, 2-63, and 1-20.

FIG. 34E shows data from the variant antibodies grouped by dose. FIG. 34F shows graphs of percent weight change for antibodies 6-3, 6-63, and 1-20.

Figure 34G:
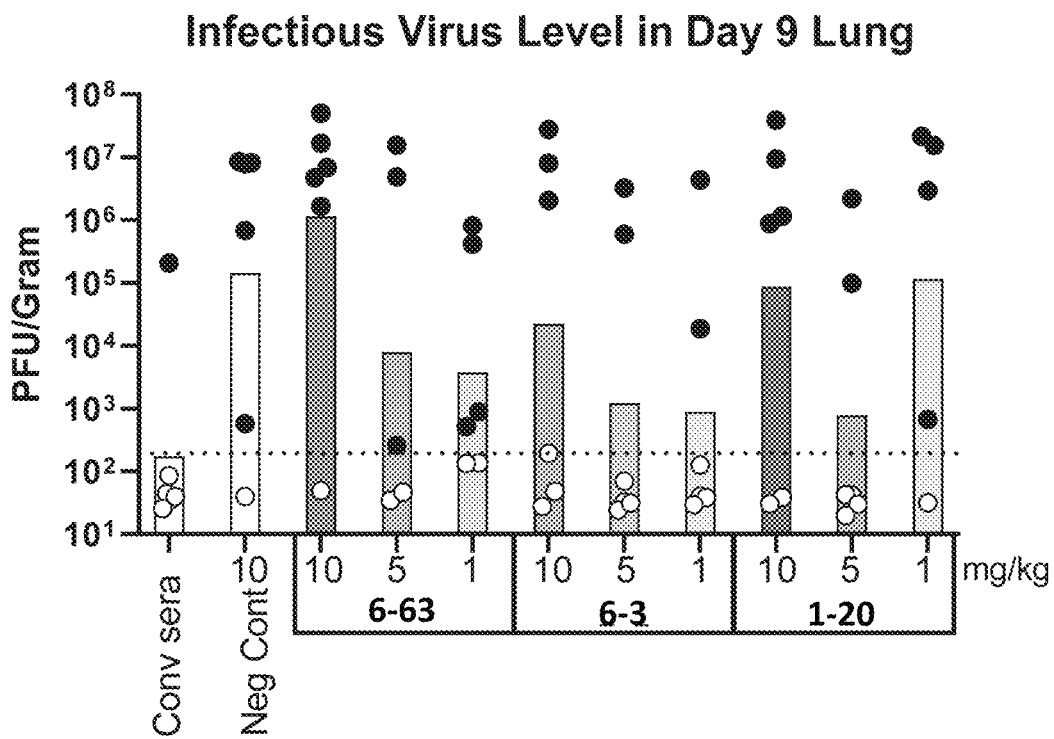
FIG. 34G shows a graph of data from a plaque assay to detect infectious virus in Day 9 lungs. The indicated antibodies were administered Day −1. Lungs were collected on Day 9, the right lobe was homogenized, clarified and supernatants were quantified by plaque titration. Individual hamster values are shown as symbols. White symbols indicate no infectious virus detected. The geometric mean PFU/gram is shown as bars. Limit of assay shown as dotted line.
Figure 34H:
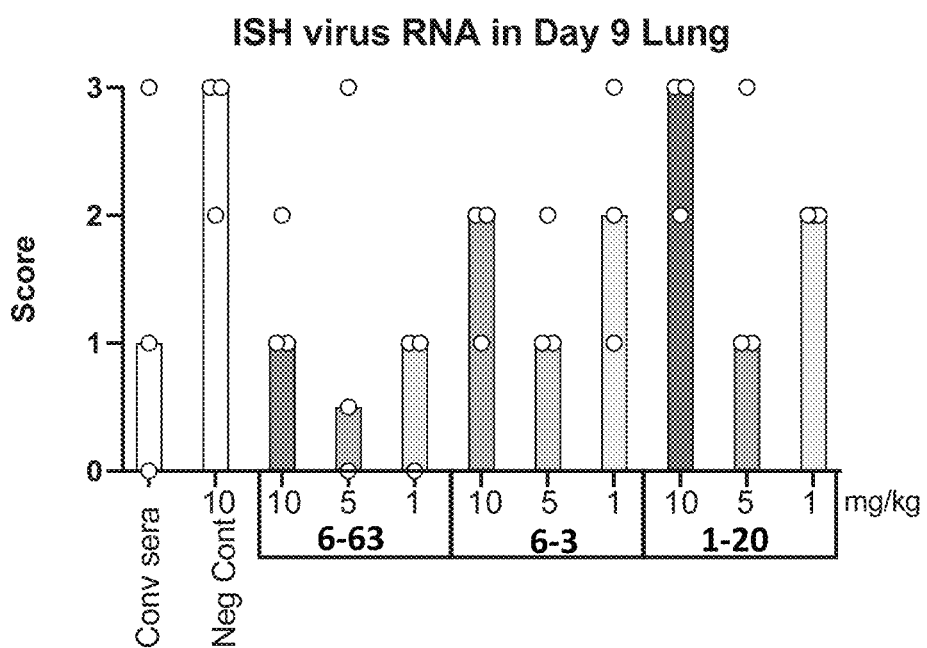
FIG. 34H shows a graph of data from in situ hybridization (ISH) to detect infected cells in Day 9 lungs. The indicated antibodies were administered Day −1. Three animals per group were analyzed. Individual hamster values are shown as symbols. Median ISH scores are shown as bars.

In wild type hamsters, virus is typically cleared by Day 7. However, in the cyclophosphamide model, viral levels are not suppressed unless there is intervention (e.g. protective antibodies administered) or the cyclophosphamide is discontinued to allow immune response and clearance. In this experiment the positive control human convalescent serum eliminated virus from the lungs from all except one hamster. In contrast, all but one of the hamsters injected with negative control antibody still had infectious virus in the lungs. Interestingly, hamsters prophylactically treated (24 hour previous to exposure) with any of the three antibodies at the highest dose (10 mg/kg) had infectious virus in the lungs of at least half the animals assessed 9 days later. Paradoxically, 6-63 and 6-3 at the lower doses (5 and 1 mg/kg) had animals with relatively less infectious virus in the lungs. 4 of 6 animals injected with 1-20 at 5 mg/kg dose animals had no detectable virus in the lungs. When the doses of that antibody was reduced to 1 mg/kg, all but one animal had infectious virus. Data is seen in FIGS. 34G-34H.

Figure 34I:
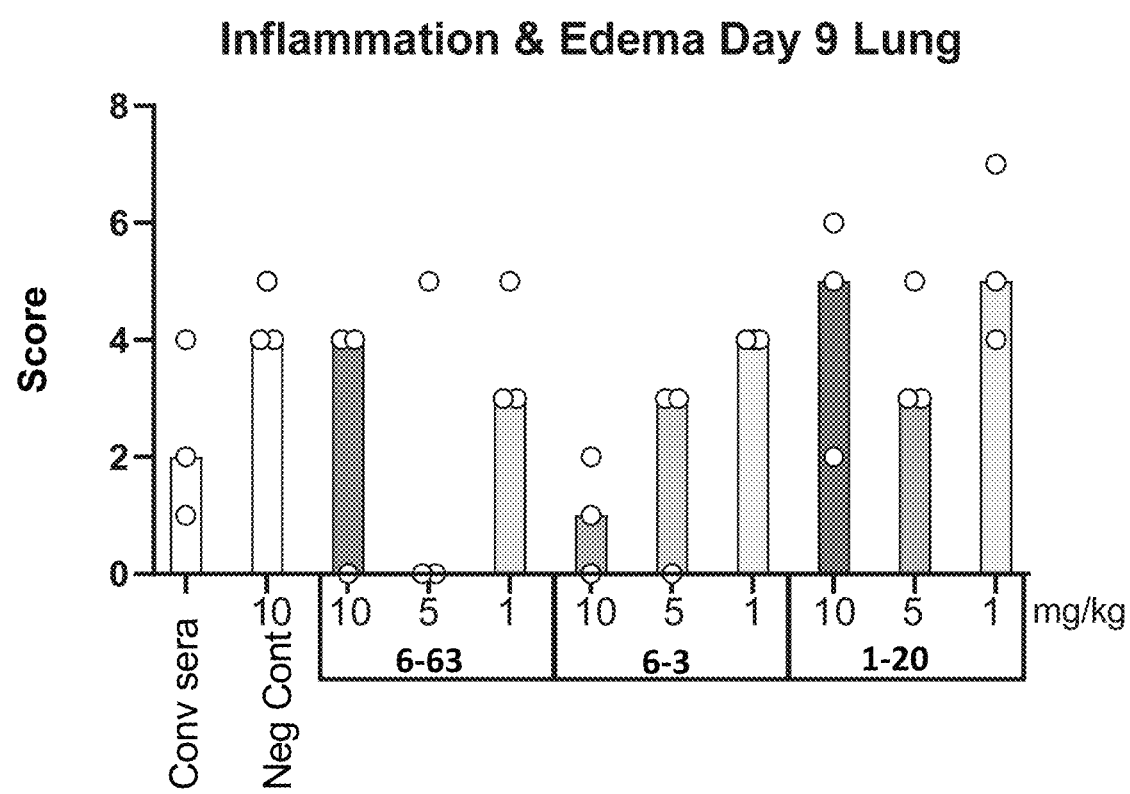
FIG. 34I shows a graph of data from cumulative inflammation and edema scores for Day 9 lungs. The indicated antibodies were administered Day −1. Three animals per group were analyzed. Individual hamster cumulative pathology scores are shown as symbols. Median scores are shown as bars.
Figure 36A:
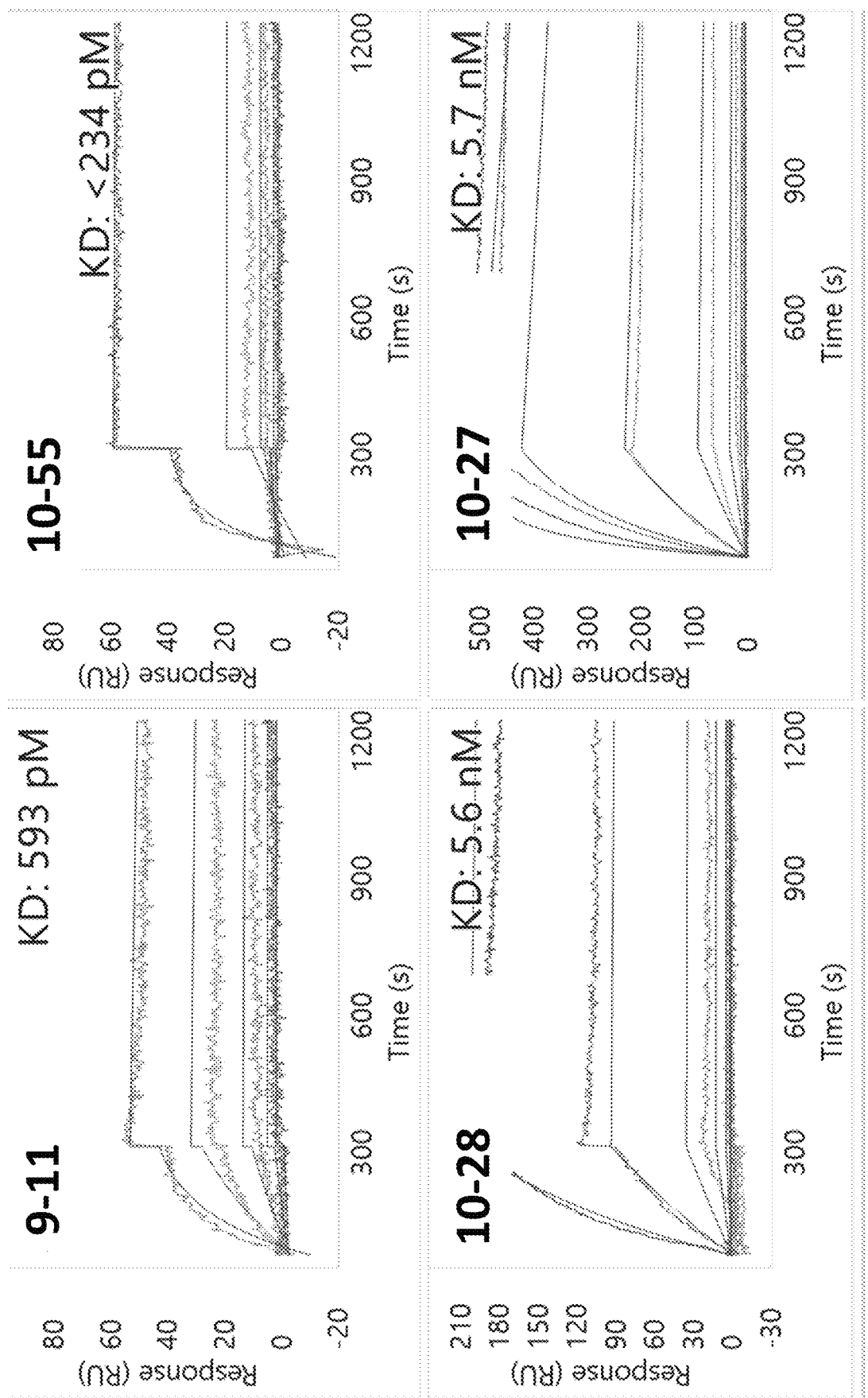
FIGS. 36A-36D show graphs of membrane glycoprotein variant antibodies binding.
Figure 36B:
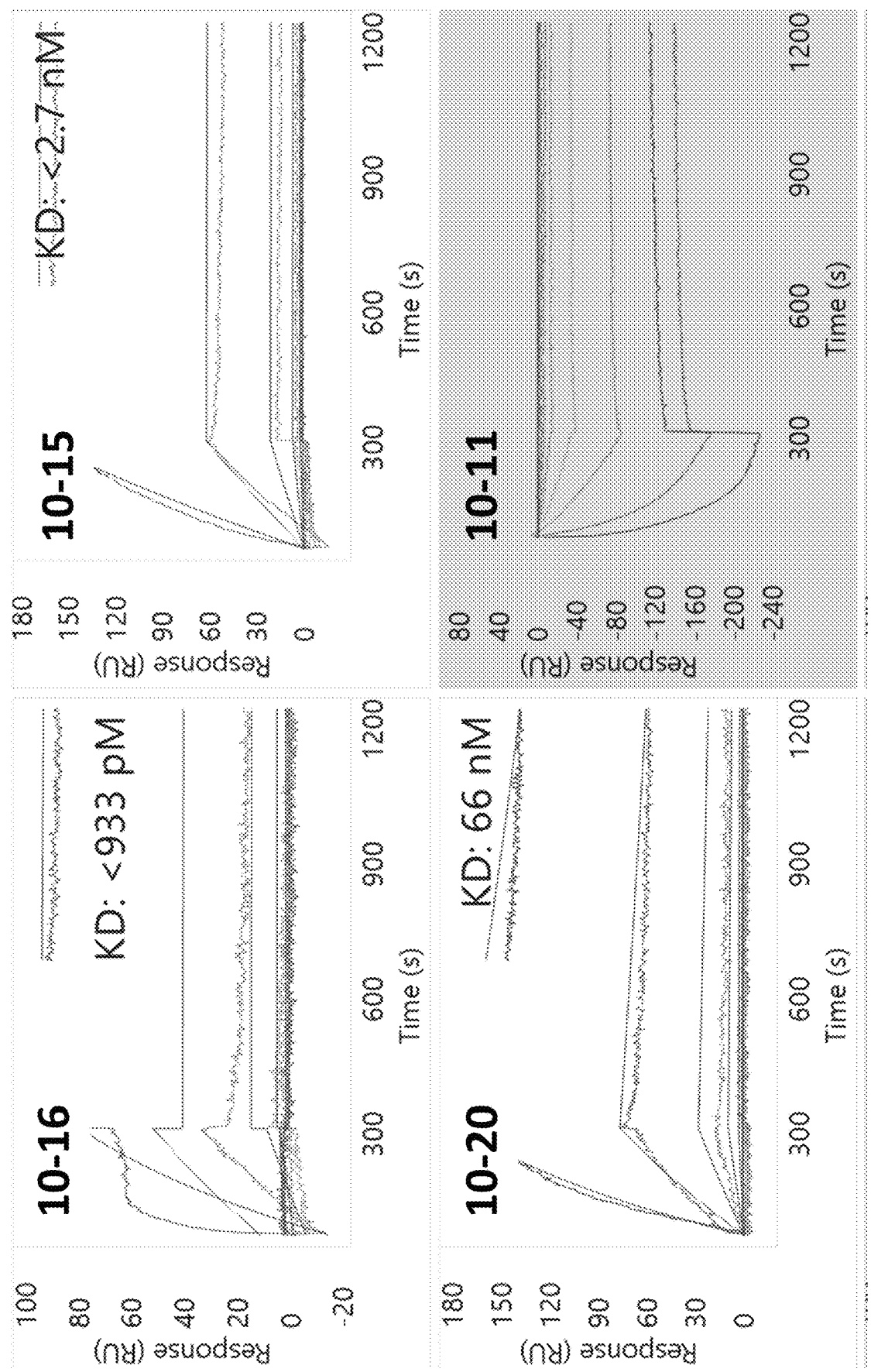
Figure 36C:
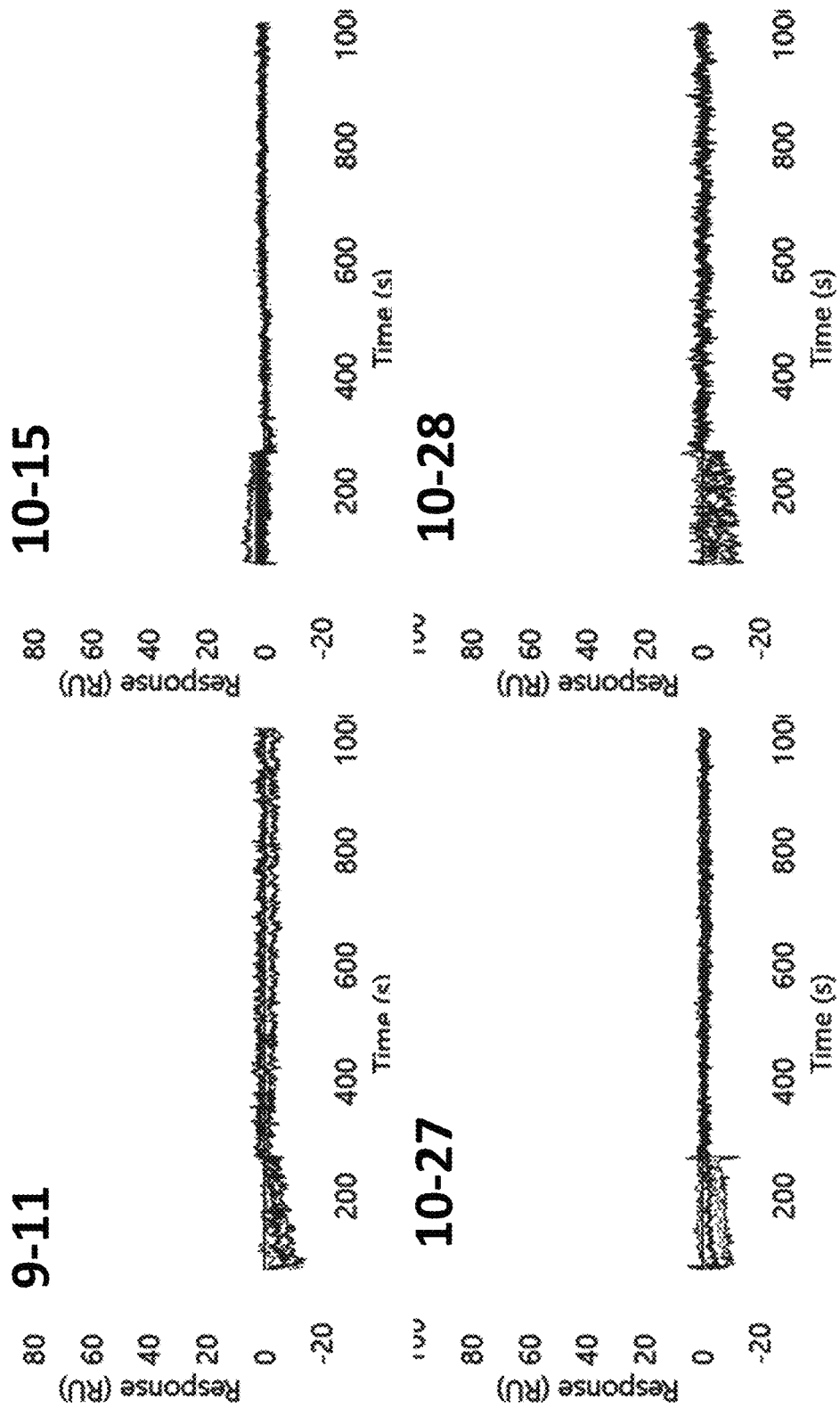
Figure 36D:
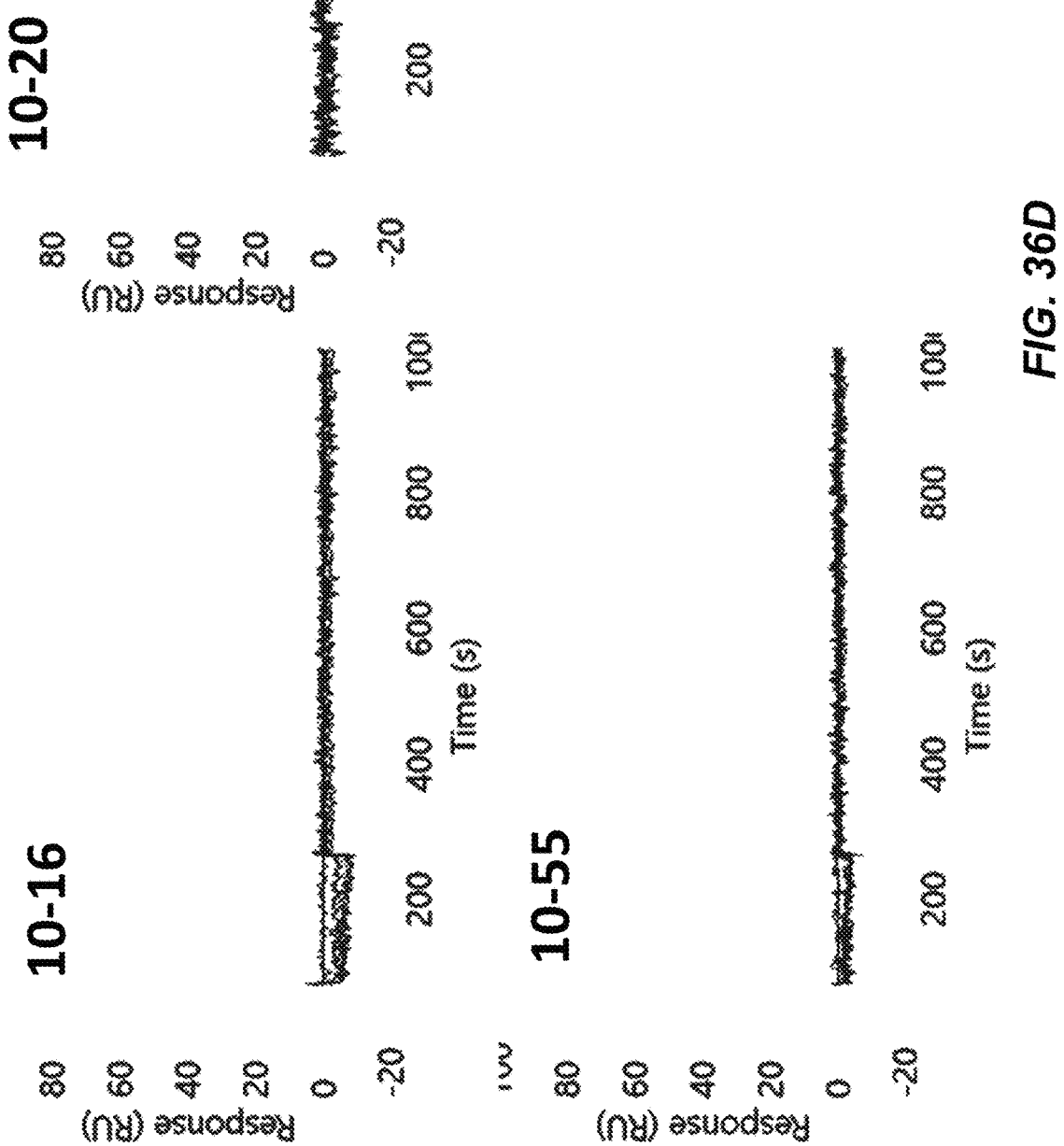

Lung pathology inflammation and edema scores from three animals were added per group and plotted (FIG. 34I). These were the same lungs used to score ISH. The convalescent sera positive control median score was 2 and the negative control was 4. The only groups with a median score lower than the negative control group were 1 and 5 mg/kg 6-63, 10 and 5 mg/kg 6-3, and 5 mg/kg 1-20. The highest median pathology scores were the 1 and 10 mg/kg 1-20 groups. The lowest median pathology score was the 5 mg/kg 6-63 group.

Example 9. SARS-CoV-2 Membrane Protein Panning

Variant SARS-CoV-2 antibodies targeting the membrane protein were generated and panned similar to Example 4.

An exemplary construct is seen in FIG. 35. The membrane protein variants were assayed for binding affinity to SARS-CoV-2 membrane protein (data not shown). The membrane protein variants bound in the picomolar and nanomolar range and did not bind to GFP fusion protein as seen in FIGS. 36A-36D.

Figure 37A:
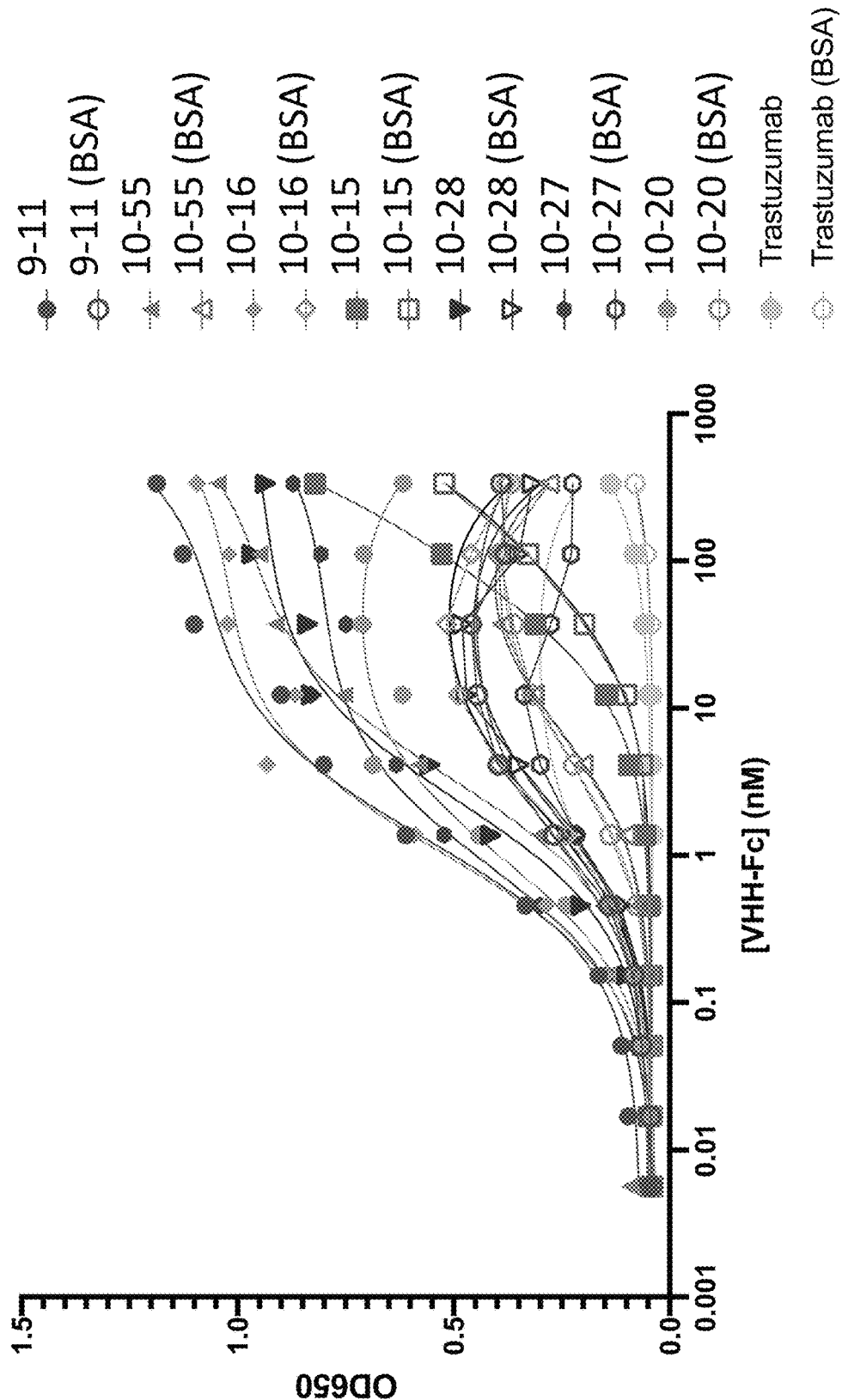
FIG. 37A-37B show graphs of ELISA assays of membrane glycoprotein variant antibodies.
Figure 37B:
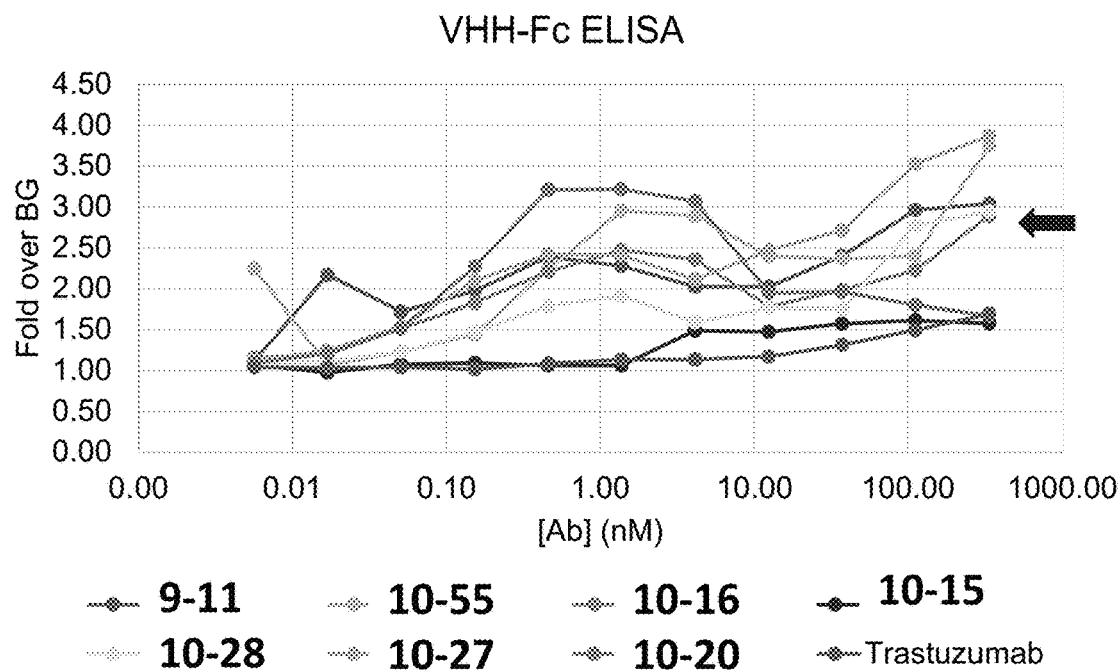
Figure 38A:
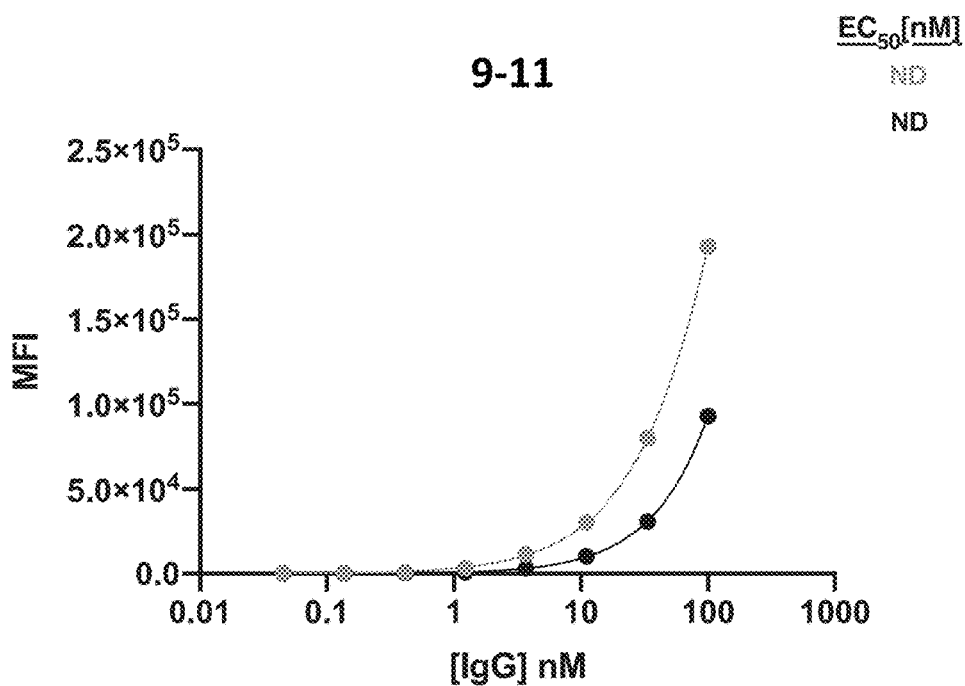
Figure 38F:
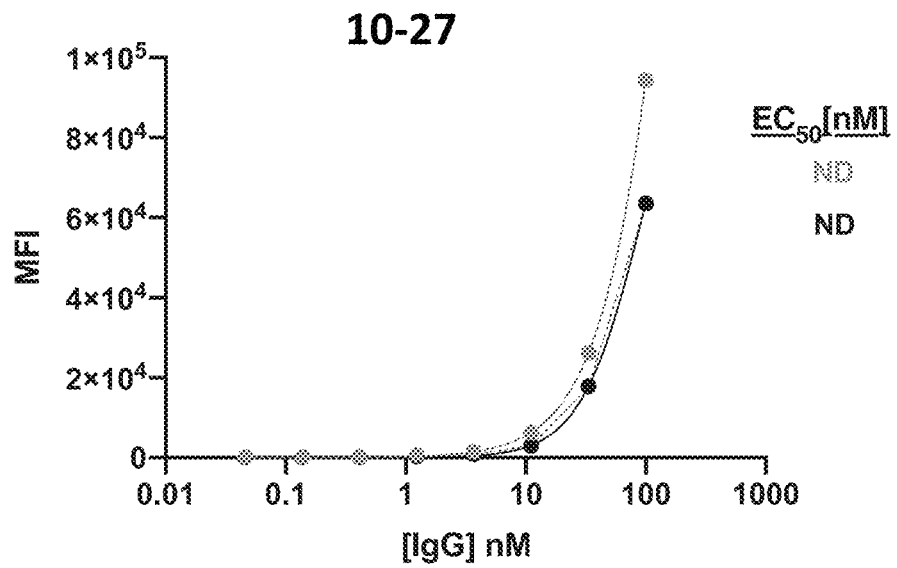
Figure 38G:
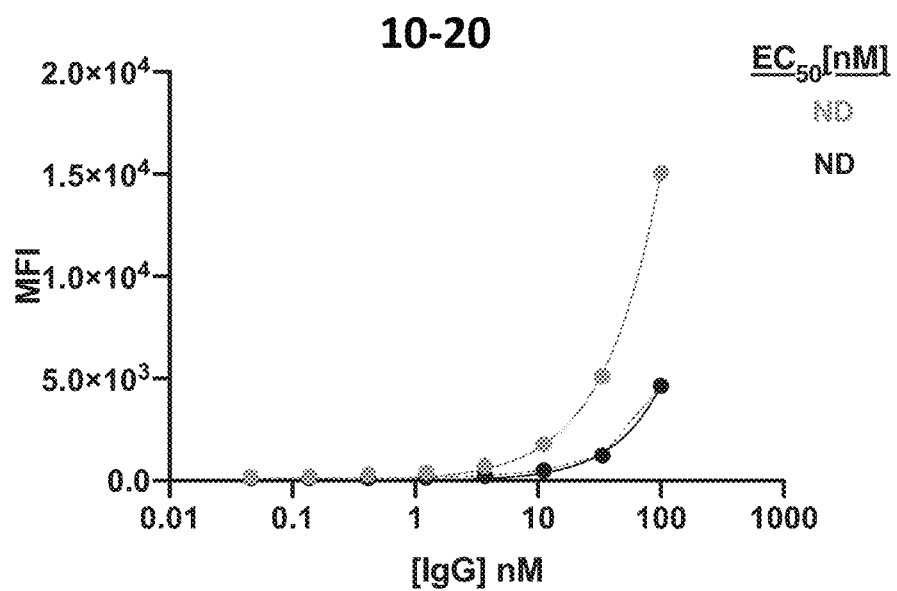

ELISA assays were performed. Briefly, 1 ug/ml antigen immobilized on Nunc Maxisorp plate. 0.01-333 nM of the antibodies were added to the plate. The secondary antibody used was anti-human Fc-HRP secondary. The data is seen in Tables 16A-16B and FIGS. 37A-37B.

TABLE 16A

| [Ab] (nM) | 9-1 M-GFP | 9-1 BSA | 10-55 M-GFP | 10-55 BSA | 10-16 M-GFP | 10-16 BSA | 10-15 M-GFP | 10-15 BSA | 10-28 M-GFP | 10-28 BSA | 10-27 M-GFP | 10-27 BSA | 10-20 M-GFP | 10-20 BSA | Trastuzumab M-GFP | Trastuzumab BSA |
|---|---|---|---|---|---|---|---|---|---|---|---|---|---|---|---|---|
| 333.33 | 1.19 | 0.39 | 1.05 | 0.28 | 1.10 | 0.38 | 0.82 | 0.52 | 0.94 | 0.32 | 0.87 | 0.23 | 0.62 | 0.37 | 0.14 | 0.08 |
| 111.11 | 1.13 | 0.38 | 0.95 | 0.40 | 1.02 | 0.46 | 0.53 | 0.33 | 0.97 | 0.35 | 0.81 | 0.23 | 0.71 | 0.40 | 0.08 | 0.06 |
| 37.04 | 1.10 | 0.46 | 0.91 | 0.39 | 1.02 | 0.52 | 0.31 | 0.20 | 0.84 | 0.48 | 0.75 | 0.28 | 0.71 | 0.36 | 0.06 | 0.05 |
| 12.35 | 0.90 | 0.45 | 0.75 | 0.32 | 0.87 | 0.49 | 0.15 | 0.10 | 0.83 | 0.47 | 0.83 | 0.34 | 0.62 | 0.32 | 0.05 | 0.04 |
| 4.12 | 0.80 | 0.40 | 0.58 | 0.20 | 0.93 | 0.40 | 0.09 | 0.06 | 0.55 | 0.35 | 0.63 | 0.30 | 0.69 | 0.22 | 0.05 | 0.04 |
| 1.37 | 0.61 | 0.27 | 0.30 | 0.10 | 0.59 | 0.24 | 0.06 | 0.06 | 0.41 | 0.22 | 0.52 | 0.22 | 0.44 | 0.14 | 0.05 | 0.04 |
| 0.46 | 0.33 | 0.14 | 0.16 | 0.07 | 0.29 | 0.13 | 0.05 | 0.05 | 0.21 | 0.12 | 0.30 | 0.12 | 0.24 | 0.08 | 0.04 | 0.04 |
| 0.15 | 0.16 | 0.08 | 0.07 | 0.05 | 0.15 | 0.08 | 0.05 | 0.04 | 0.10 | 0.07 | 0.15 | 0.07 | 0.12 | 0.05 | 0.04 | 0.04 |
| 0.05 | 0.11 | 0.07 | 0.06 | 0.04 | 0.08 | 0.05 | 0.04 | 0.04 | 0.06 | 0.05 | 0.08 | 0.05 | 0.07 | 0.04 | 0.04 | 0.04 |
| 0.02 | 0.10 | 0.04 | 0.05 | 0.04 | 0.05 | 0.04 | 0.04 | 0.04 | 0.05 | 0.04 | 0.05 | 0.04 | 0.05 | 0.04 | 0.04 | 0.04 |
| 0.01 | 0.05 | 0.04 | 0.09 | 0.04 | 0.05 | 0.04 | 0.04 | 0.04 | 0.04 | 0.04 | 0.05 | 0.04 | 0.05 | 0.04 | 0.04 | 0.04 |

TABLE 16B

| [Ab] (nM) | 9-11 | 10-55 | 10-16 | 10-15 | 10-28 | 10-27 | 10-20 | Trastuzumab |
|---|---|---|---|---|---|---|---|---|
| 333.33 | 3.04 | 3.74 | 2.88 | 1.57 | 2.94 | 3.87 | 1.67 | 1.69 |
| 111.11 | 2.96 | 2.39 | 2.22 | 1.61 | 2.77 | 3.52 | 1.79 | 1.49 |
| 37.04 | 2.39 | 2.36 | 1.98 | 1.57 | 1.74 | 2.71 | 1.96 | 1.31 |
| 12.35 | 2.02 | 2.39 | 1.77 | 1.47 | 1.76 | 2.46 | 1.94 | 1.17 |
| 4.12 | 2.02 | 2.89 | 2.35 | 1.49 | 1.59 | 2.11 | 3.07 | 1.13 |
| 1.37 | 2.27 | 2.95 | 2.47 | 1.06 | 1.90 | 2.40 | 3.21 | 1.13 |
| 0.46 | 2.38 | 2.23 | 2.20 | 1.06 | 1.79 | 2.42 | 3.21 | 1.08 |
| 0.15 | 1.97 | 1.44 | 1.82 | 1.09 | 1.47 | 2.09 | 2.27 | 1.01 |
| 0.05 | 1.72 | 1.23 | 1.51 | 1.07 | 1.23 | 1.54 | 1.51 | 1.04 |
| 0.02 | 2.16 | 1.06 | 1.20 | 0.97 | 1.11 | 1.24 | 1.21 | 1.03 |
| 0.01 | 1.12 | 2.24 | 1.15 | 1.07 | 1.08 | 1.12 | 1.09 | 1.04 |

FACS titration was also performed. Data is seen in Table 16C and FIGS. 38A-38J.

| [IgG] nM | 9-11 | 10-55 | 10-16 | 10-15 | 10-28 | 10-27 | 10-20 | ProSci Sars-Cov2-M1 | ProSci Sars-Cov2-M1 | ProteinTech Sars-Cov2-M1 |
|---|---|---|---|---|---|---|---|---|---|---|
| 100 | 2.08 | 2.80 | 3.07 | 2.72 | 13.46 | 1.49 | 3.23 | 5.60 | 3.51 | 6.07 |
| 33.333 | 2.58 | 4.10 | 4.61 | 2.27 | 9.80 | 1.47 | 4.10 | 3.72 | 2.82 | 4.85 |
| 11.111 | 2.96 | 3.43 | 3.22 | 2.05 | 5.87 | 2.09 | 3.58 | 2.83 | 2.20 | 4.79 |
| 3.704 | 3.63 | 2.46 | 2.31 | 1.77 | 3.05 | 1.81 | 3.00 | 2.05 | 1.89 | 3.13 |
| 1.235 | 3.37 | 1.48 | 1.95 | 1.55 | 2.54 | 2.68 | 2.62 | 1.94 | 2.92 | 1.89 |
| 0.412 | 2.38 | 1.31 | 1.52 | 1.36 | 1.99 | 1.70 | 2.13 | 1.83 | 2.00 | 1.64 |
| 0.137 | 2.00 | 1.37 | 1.27 | 1.36 | 1.58 | 1.26 | 1.45 | 1.91 | 1.81 | 1.48 |
| 0.046 | 1.61 | 1.38 | 1.31 | 1.76 | 1.60 | 1.37 | 1.49 | 1.61 | 1.63 | 1.59 |

Figure 39A:
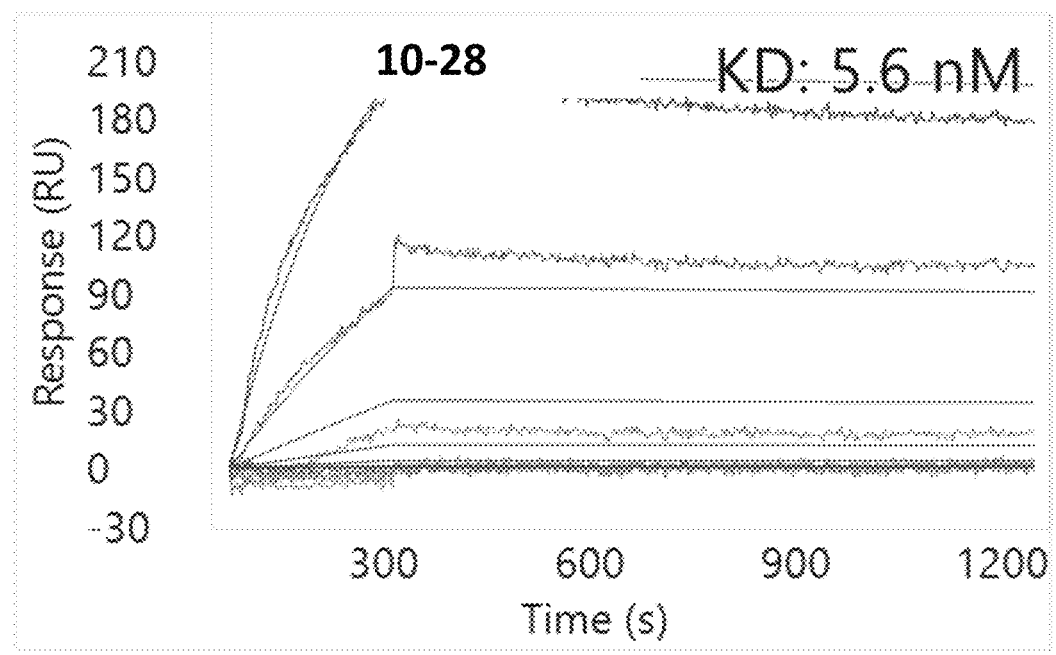
FIGS. 39A-39B show graphs of binding affinity and binding for membrane glycoprotein variant antibodies.
Figure 39B:
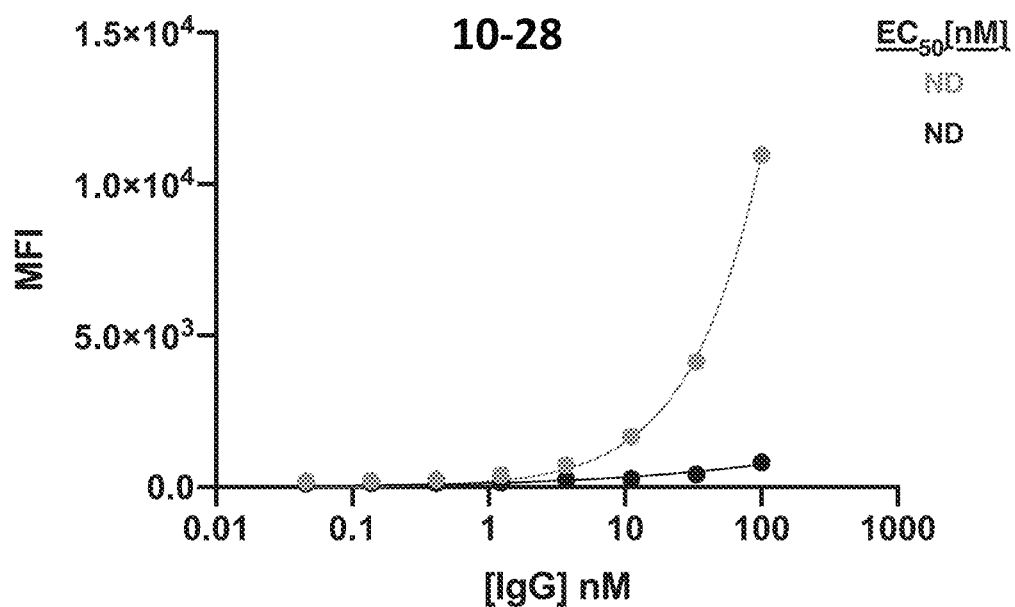

Data for antibodies having improved affinity and binding is seen in Table 16D and FIGS. 39A-39B.

TABLE 16D

| Variant | MFI Expressing | MFI Parent | MFI Ratio |
|---|---|---|---|
| 10-13 | 31498 | 3565.5 | 8.83 |
| 9-1 | 35223 | 4299 | 8.19 |
| 10-18 | 8516 | 1056 | 8.06 |
| 10-45 | 18004 | 2691 | 6.69 |
| 10-26 | 8204.5 | 1577 | 5.20 |
| 10-22 | 14691 | 3285 | 4.47 |
| 10-48 | 11680 | 2838.5 | 4.11 |
| 10-52 | 2165 | 527 | 4.11 |
| 10-40 | 14490 | 3833 | 3.78 |
| 9-8 | 8705.5 | 2318 | 3.76 |
| ProteinTech Sars-Cov2-M1 | 7390 | 2007 | 3.68 |
| 10-38 | 8777 | 2554 | 3.44 |
| 10-61 | 19571 | 6131.5 | 3.19 |
| 9-9 | 4843 | 1541 | 3.14 |
| 10-08 | 18743 | 5964 | 3.14 |
| 10-24 | 4735.5 | 1554 | 3.05 |
| 9-4 | 26899 | 8829.5 | 3.05 |
| 10-10 | 38014 | 12508.5 | 3.04 |
| 10-58 | 12538 | 4421 | 2.84 |
| 10-35 | 3279 | 1179 | 2.78 |
| 10-07 | 2631 | 1005 | 2.62 |
| 10-46 | 14703 | 5650 | 2.60 |
| 10-23 | 24789 | 10112 | 2.45 |
| 10-37 | 6580.5 | 2727 | 2.41 |
| 10-34 | 4416 | 1837 | 2.40 |
| 10-27 | 18804 | 8030 | 2.34 |
| 10-59 | 12781 | 5560 | 2.30 |
| 10-33 | 4429.5 | 1935 | 2.29 |
| 10-14 | 5189 | 2346 | 2.21 |
| 10-21 | 28963 | 13223.5 | 2.19 |
| 10-49 | 6702 | 3071.5 | 2.18 |
| 10-39 | 12127.5 | 5731 | 2.12 |
| 10-04 | 5561 | 2638 | 2.11 |
| 10-28 | 18309 | 8872.5 | 2.06 |
| 10-53 | 5940.5 | 2920 | 2.03 |
| 10-12 | 11043 | 5451 | 2.03 |
| 9-5 | 79505 | 40263 | 1.97 |
| 10-25 | 2231 | 1136 | 1.96 |
| 9-7 | 60739 | 31110 | 1.95 |
| 10-03 | 35529 | 19063.5 | 1.86 |
| 10-32 | 25569 | 13832 | 1.85 |
| 10-20 | 29454 | 16158 | 1.82 |
| 10-36 | 31774 | 17549 | 1.81 |
| 10-57 | 29745 | 16648 | 1.79 |
| 10-54 | 89446 | 50215 | 1.78 |
| 10-41 | 8910 | 5090.5 | 1.75 |
| 10-42 | 70764 | 40576 | 1.74 |

TABLE 16D-continued

| Variant | MFI Expressing | MFI Parent | MFI Ratio |
|---|---|---|---|
| 10-50 | 423775 | 246262 | 1.72 |
| 10-31 | 1460 | 880.5 | 1.66 |
| 9-11 | 141975 | 87474 | 1.62 |
| 10-47 | 70545.5 | 43576.5 | 1.62 |
| 10-09 | 41228 | 25611.5 | 1.61 |
| 9-3 | 45285 | 28206 | 1.61 |
| 10-05 | 70182 | 44064 | 1.59 |
| 10-17 | 69948 | 44097.5 | 1.59 |
| 10-30 | 37623.5 | 23973 | 1.57 |
| 10-11 | 43592 | 27861 | 1.56 |
| 10-43 | 16903.5 | 10901 | 1.55 |
| 10-19 | 74841 | 48651 | 1.54 |
| 9-10 | 123764 | 81408 | 1.52 |
| 10-29 | 6272 | 4230.5 | 1.48 |
| 10-51 | 91221 | 61911 | 1.47 |
| 9-6 | 669267 | 454499.5 | 1.47 |
| 10-44 | 19771 | 13568 | 1.46 |
| 10-56 | 11075.5 | 7946 | 1.39 |
| 9-2 | 936 | 721 | 1.30 |
| Stained Control R | 208 | 164 | 1.27 |
| 10-02 | 413 | 331 | 1.25 |
| 10-55 | 1951.5 | 1585 | 1.23 |
| Stained Control H | 198 | 166 | 1.19 |
| 10-60 | 100191.5 | 87809 | 1.14 |
| 10-01 | 958 | 884 | 1.08 |
| 10-06 | 1375 | 1273 | 1.08 |
| 10-15 | 1912 | 1777 | 1.08 |
| 10-16 | 910 | 866 | 1.05 |

Figure 40A:
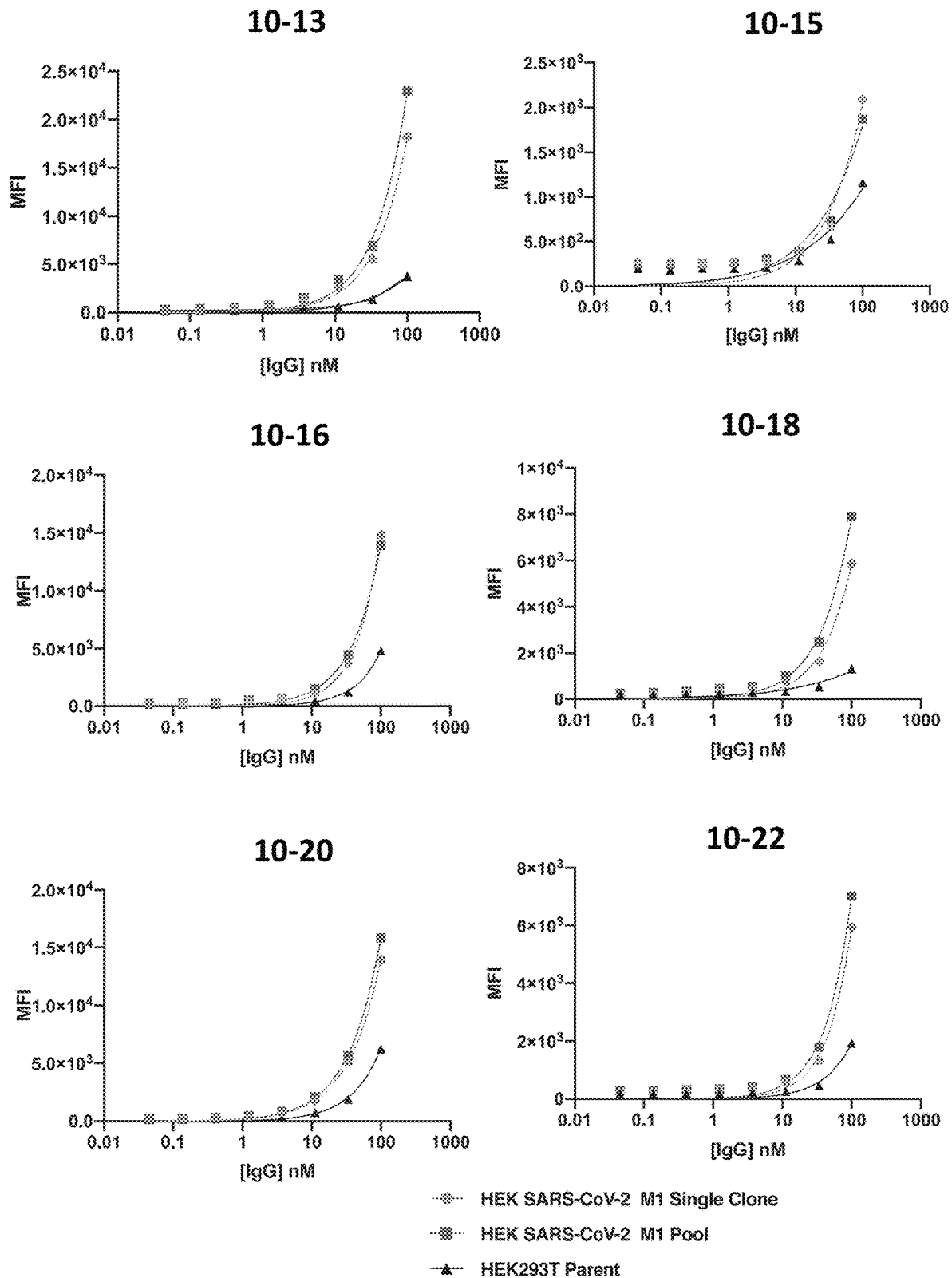
FIGS. 40A-40D show graphs of flow titrations for pool and single pool HEK for membrane protein antibodies.
Figure 40B:
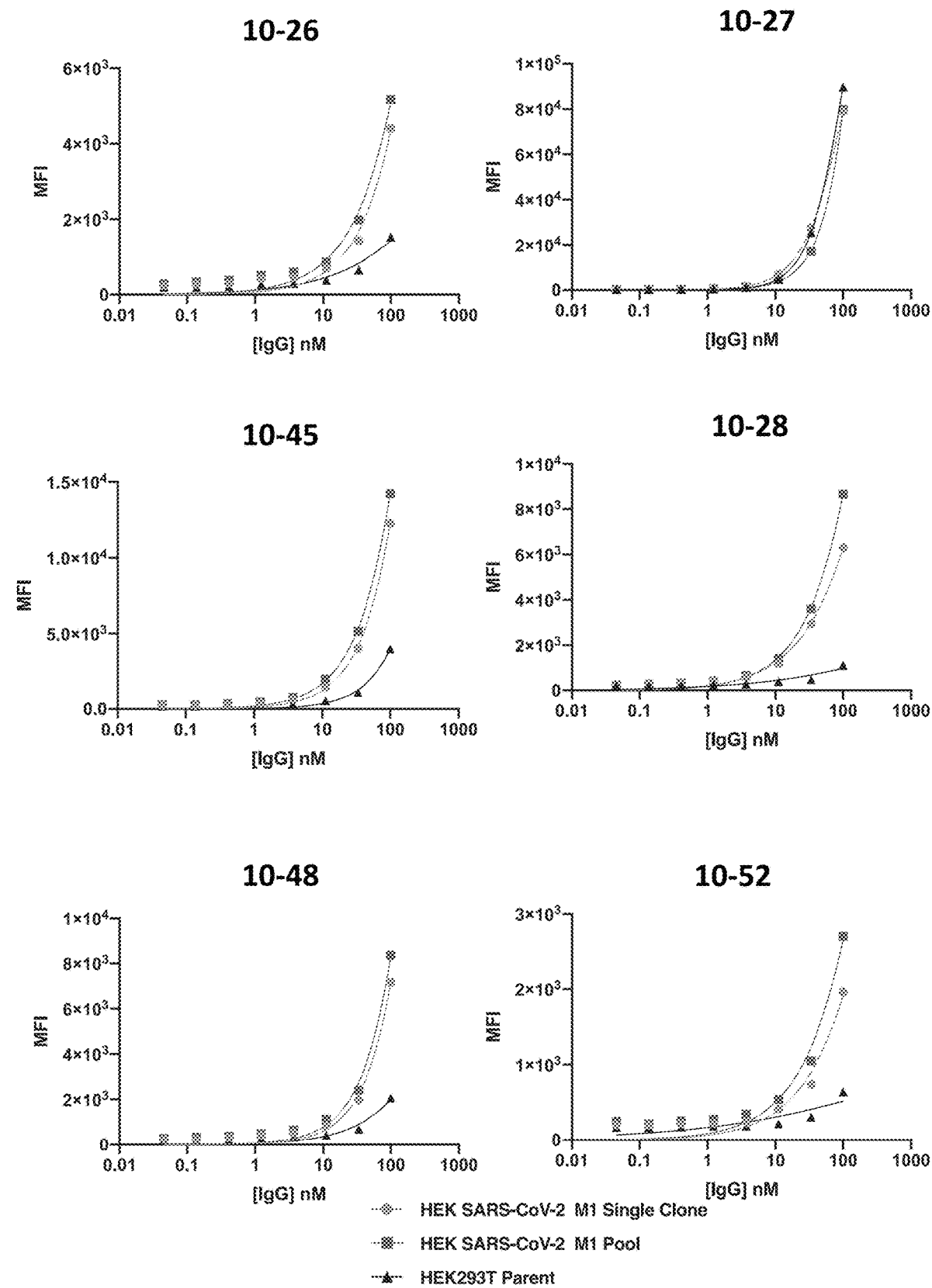
Figure 40C:
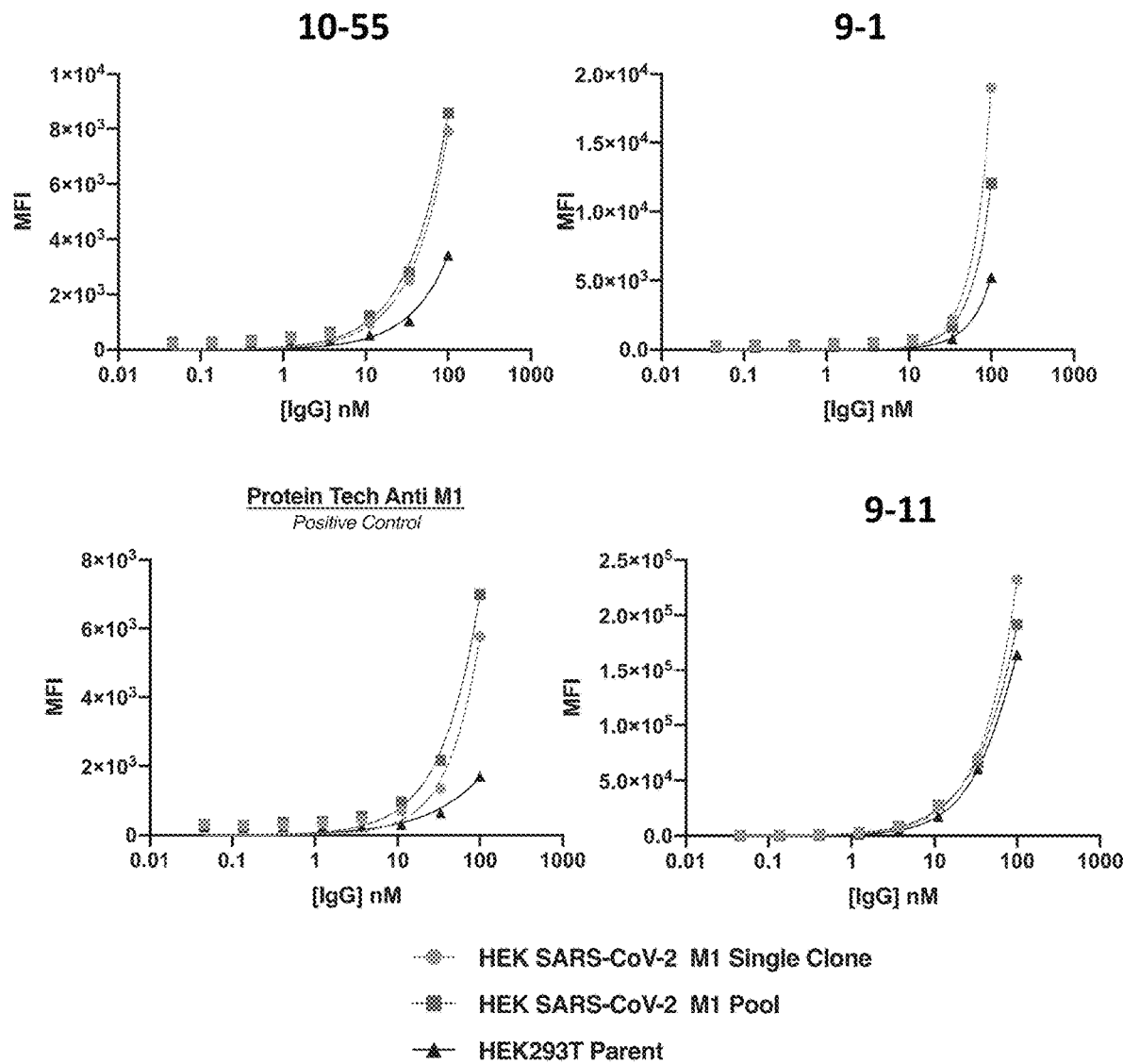
Figure 40D:
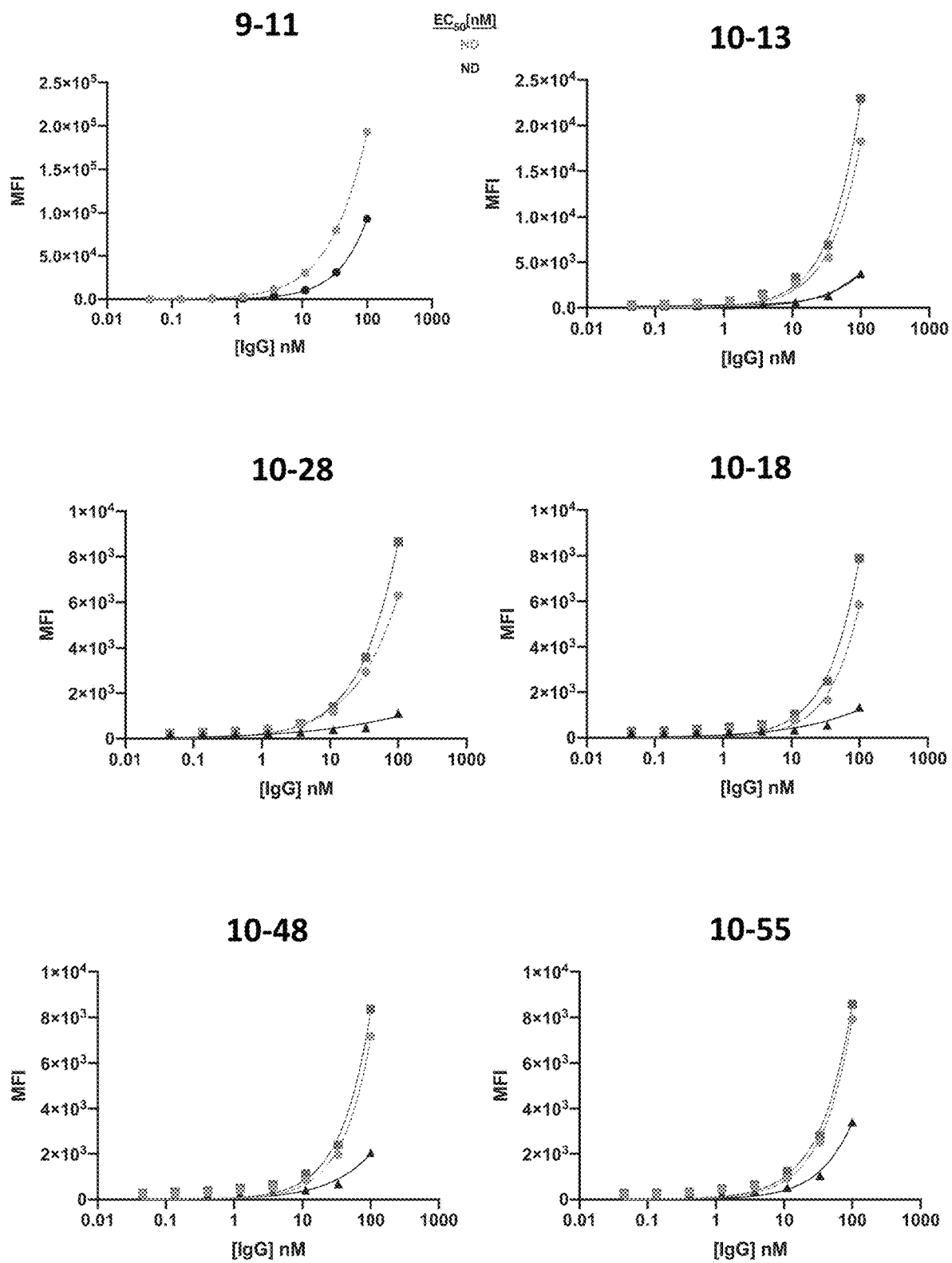

The membrane protein antibodies were assayed in flow titration assay for pool and single pool HEK. Data is seen in FIGS. 40A-40C. Of the membrane protein antibodies, 9-11, 10-13, 9-28, 10-18, 10-48, and 10-55 exhibited improved characteristics (FIG. 40D).

Example 10. VSV-Pseudotype Neutralization Analysis of Antibodies for SARS-CoV-2 B.135 (South African Strain)

Antibodies described herein were tested in a VSV-pseudotype neutralization assay for SARS-CoV-2 B.135 (South African strain).

Briefly, aerial semi-log dilutions of all test antibodies (TA) and control were prepared and mixed with the VSV-pseudotype virus in a 1:1 ratio for 1 h at RT followed by incubation over Vero cells (ATCC® CCL-81™) seeded at 60,000 cells per well at 37° C. The cells were lysed the following day and luciferase activity was measured to assess the potency of each TA to block viral entry into the Vero cells. All samples will be run in triplicate. Data analysis is conducted using XLFit and Graphpad Prism. The testing concentrations and plate plan are seen in Table 17.

TABLE 17

Testing Concentrations and Plate Plan

| | Samples | Stock (mg/mL) | Target conc/ dilution | In plate concentration |
|---|---|---|---|---|
| 1 | 6-63 | 6.39 | 100 ug/mL | 50.00 ug/mL |
| 2 | 6-3 | 10.05 | 100 ug/mL | 50.00 ug/mL |
| 3 | 1-12 | 2.24 | 100 ug/mL | 50.00 ug/mL |
| 4 | mouse pAb | 1 | 1:25 | 1:50 |

Figure 41A:
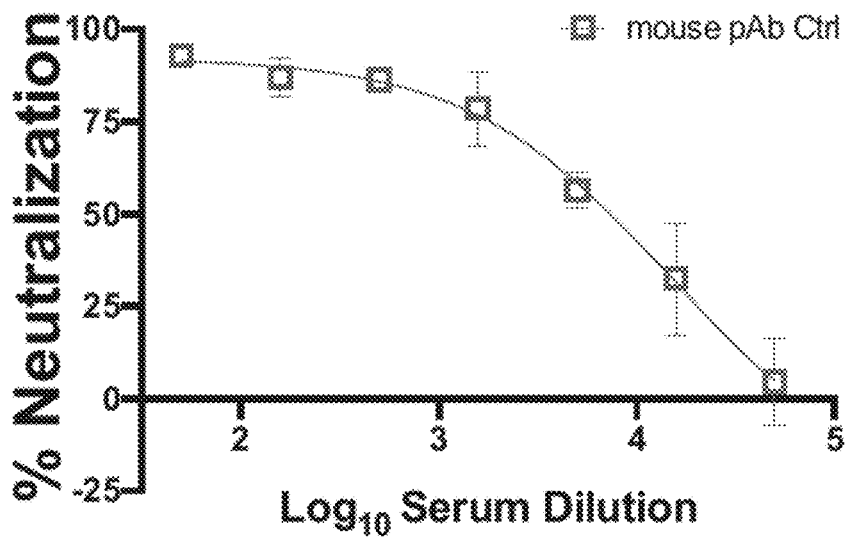
FIG. 41A shows a graph of the positive control pAb in a neutralization assay.
Figure 41B:
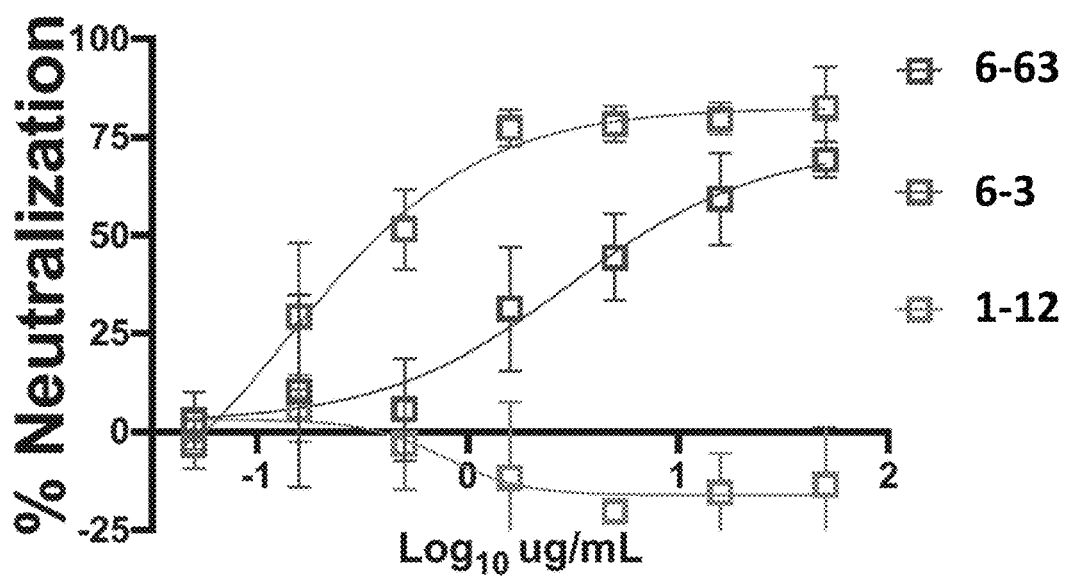
FIG. 41B shows a graph of neutralization of antibodies 6-63, 6-3, and 1-12 in VSV-SARS B.135 strain.

Data is seen in FIGS. 41A-41B. FIG. 41A illustrates positive control pAb has an NT50 of 1:14,993 dilution as expected. FIG. 41B illustrates antibodies 6-63 and 6-3 neutralize VSV-SARS B.135 strain with IC50s of ~3.07 ug/mL and 0.143 ug/mL, respectively. Antibody 1-12 failed to neutralize VSV-SARS B.135 strain.

Example 11. VSV-Pseudotype Neutralization Analysis of Antibodies for SARS-CoV-2 D614G Variant Antibodies described herein were tested in a VSV-pseudotype neutralization assay for SARS-CoV-2 SARS CoV-2 S D614G variant.

Briefly, serial semi-log dilutions of all test antibodies (TA) and control were prepared and mixed with the VSV-pseudotype virus in a 1:1 ratio for 1 h at RT followed by incubation over Vero cells (ATCC® CCL-81™) seeded at 60,000 cells per well at 37° C. The cells were lysed the following day and luciferase activity was measured to assess the potency of each TA to block viral entry into the Vero cells. All samples will be run in triplicate. Data analysis is conducted using XLFit and Graphpad Prism.

Data is seen in FIGS. 42A-42D. FIG. 42A shows the positive control.

Example 13. Antibody Cocktails for Treating SARS-CoV-2 in Syrian Hamsters

This Example demonstrates pre- and post-exposure efficacy of antibody cocktails in Syrian hamsters.

Methods

In this study the hamsters were transiently immunosuppressed using cyclophosphamide. As a strategy to de-risk selecting viruses with neutralization escape mutations a cocktail of a nanobody (nAb) and a monoclonal antibody (MAb) known to bind different spike protein epitopes were combined and used. The combined dose was 20 mg/Kg in this proof-of-concept experiment. The cocktail consisted of 10 mg/Kg of VHH nanobody 6-63 and 10 mg/Kg of monoclonal antibody 1-20. An equal number of male and female animals were used in each group.

Seventy-eight hamsters were used for this experiment according to Table 18. On Day 0, animals were exposed via intranasal (IN) instillation to 1,000 pfu of SARS-CoV-2 virus in 50 µL volume. The volume was distributed between both nares. To transiently immunosuppress, all animals were treated with cyclophosphamide starting on Day −3 (140 mg/kg dose) followed by additional doses (100 mg/kg) on Days 1, 5, and 9.

On the indicated day post exposure, MAb/nAb cocktail or c7D11 was administered via the intraperitoneal (IP) route. On Day 0 blood samples were collected from Group I for hematology to confirm immunosuppression. Group I was also the control for any adverse effects of cyclophosphamide treatment on the hamsters. Clinical scores and individual animal weights were recorded daily. Pharyngeal swabs and other key events were measured. Animals in Groups A-I were euthanized on day 14 and lungs were collected for virology and pathology. Group J animals were used for a serial pathology component of this study. Two animals from Group J (2 male and 2 female) were euthanized starting on Day 1 and then each day up to and including Day 6.

TABLE 18

Experimental design

| Group | Number of Hamsters (Pain Category) | Virus Exposure[a] (Day 0) | Treatment | Treatment Day |
|---|---|---|---|---|
| A | 6 (3 male, 3 female) (D) | SARS CoV-2 | Cocktail[b] 20 mg/Kg | −1 |
| B | 6 (3 male, 3 female) (D) | | Cocktail[b] 20 mg/Kg | +1 |
| C | 6 (3 male, 3 female) (D) | | Cocktail[b] 20 mg/Kg | +2 |
| D | 6 (3 male, 3 female) (D) | | Cocktail[b] 20 mg/Kg | +3 |
| E | 6 (3 male, 3 female) (D) | | Cocktail[b] 20 mg/Kg | +4 |
| F | 6 (3 male, 3 female) (D) | | Cocktail[b] 20 mg/Kg | +5 |
| G | 6 (3 male, 3 female) (E) | | Cocktail[b] 20 mg/Kg | +6 |
| H | 6 (3 male, 3 female) (E) | | Neg IgG control | +1 |
| I | 6 (3 male, 3 female) (C) | No virus | none | Cyclophosphamide control |
| J | 24 (12 male, 12 female) (E) | SARS CoV-2 | none | No treatment-pathology control[d] |

78 Syrian hamsters
[a] challenge with 1,000 pfu of virus in 50 microliter volume
[b] cocktail = 6-63 combined with 1-20 1:1 w/v delivered 2.5 mL per animal by i.p. route
[c] negative control 20 mg/kg
[d] Two animals (2 male and 2 female) from Group J were euthanized for pathology/virology on Days 1, 2, 3, 4, 5, 6

Results

Cyclophosphamide Treatment in Uninfected Animals does not Result in Weight Loss.

Control animals (CYP Controls, Group I), that were treated with CYP but not challenged gained weight overtime.

Negative Control Antibody c7D11 at 20 mg/kg, Group H, does not Protect Against Disease Associated Weight Loss.

Figure 43A:
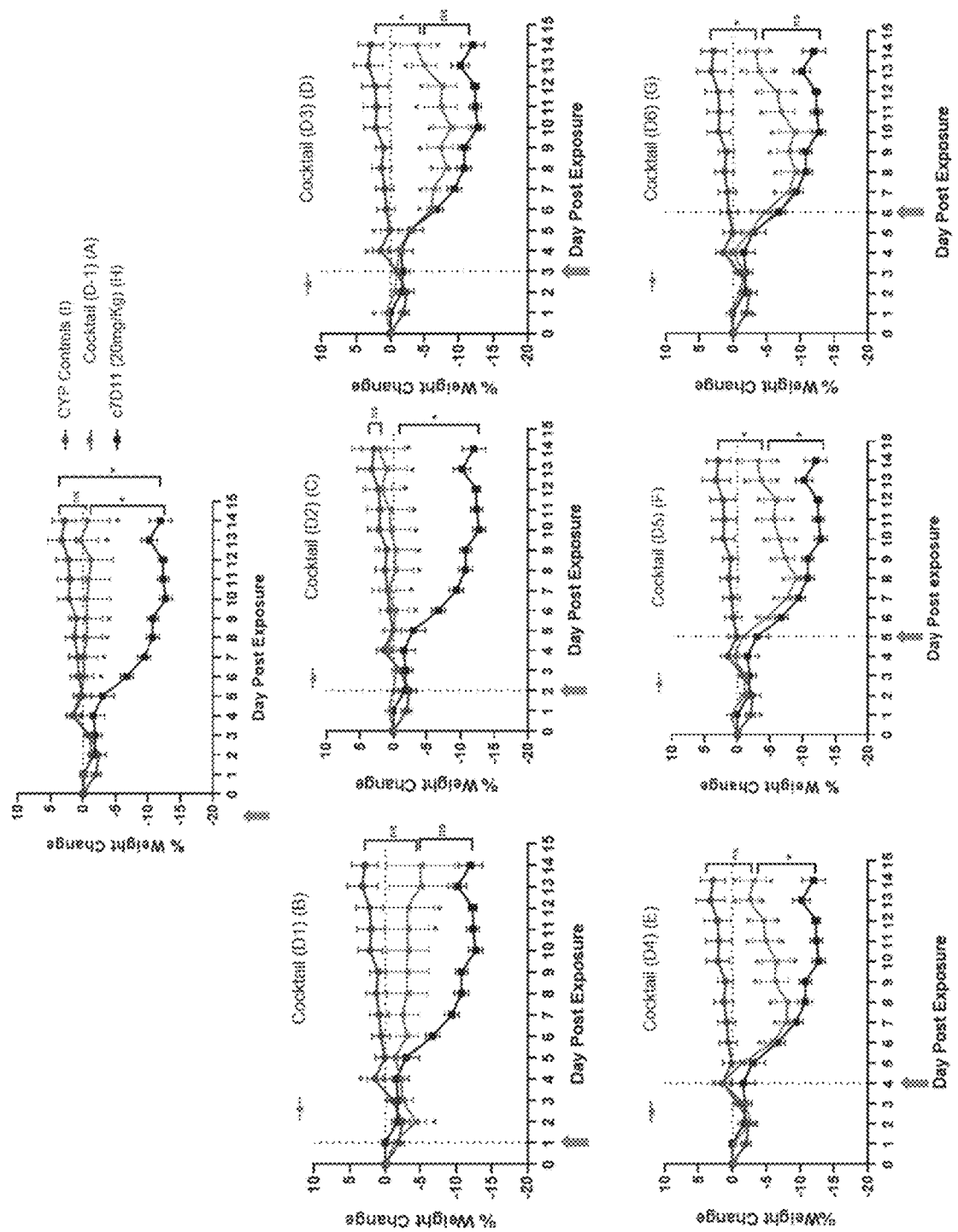
FIG. 43A shows graphs weight change. Animals were immunosuppressed and then exposed to SARS-CoV-2 virus, WA1 strain, on Day 0. Top graph indicates data from the control group that received the cocktail on Day −1 (D-1, Group A). A group was immunosuppressed but not exposed to virus (CYP Control, Group I). Negative control is an IgG monoclonal (Group H). The cocktail was administered on the indicated day post-exposure (Groups B-G; middle and bottom graphs). Arrows indicate day of antibody administration. Symbols are mean±SEM. Statistical differences in the area under the curve (AOC) are shown to the right of each line. * indicates p value <0.05, ns=not significant.

Hamsters in Group H lost weight starting on Day 6 (FIG. 43A). Weight loss continued until Day 10 when it leveled off Animals were still below 10% of their starting weight on the last day of the experiment (Day 14).

The Cocktail Administered One Day Prior to Exposure Protected Against Weight Loss.

Hamsters in Group A maintained their weight and stayed within 1% of starting weight (FIG. 43A). This confirmed that treatment with neutralizing antibodies before exposure was sufficient to protect against significant weight loss.

Post-Exposure Treatment of CYP Hamster Model of COVID19 Produces Variable Weight Loss Effects/Patterns.

Figure 43B:
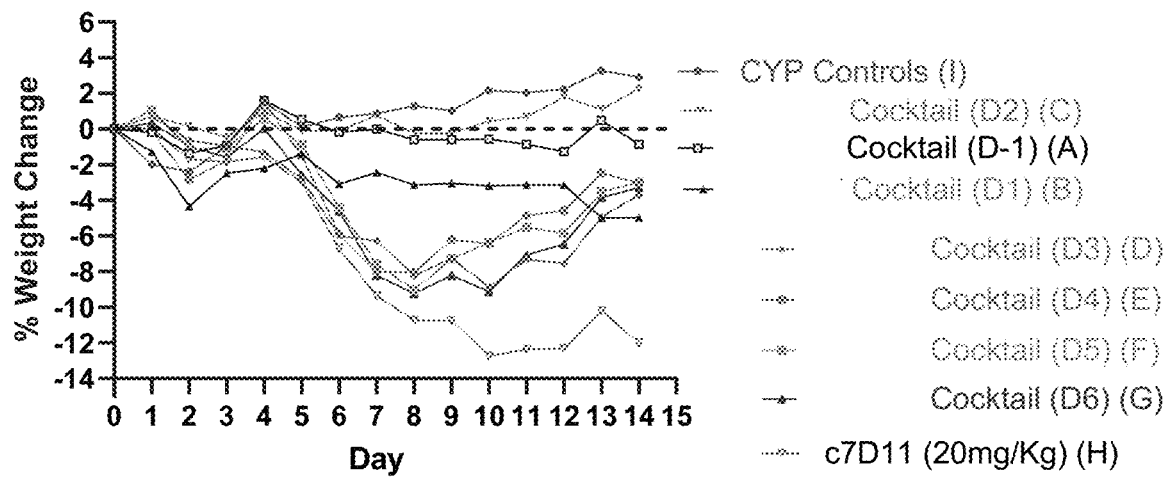
FIG. 43B shows a graph of data from FIG. 43A plotted on one graph.

A onetime treatment of a cocktail containing 1-20 and 6-63 at final dose of 20 mg/Kg was administered on Days 1 (B), 2 (C), 3 (D), 4 (E), 5 (F), and 6 (G). The percent weight change relative to Day 0 are shown in FIG. 43A. Arrows and dotted vertical lines indicate the day of treatment specific for the treatment regimen being compared. The same data is shown collectively in FIG. 43B. Note that there were two animals in Group B (Day 1) that dropped weight a typically during the experiment and one animal succumbed on Day 12. That animal had a necrotic/hemorrhaging testicle due to an apparent torsion event and was excluded from analysis. No assignable cause was identified for the second animal so that animal was not excluded from analysis. Statistical analysis was performed to compare both the CYP Control (Group I) and the negative control antibody (c7d11, Group H) to all other groups. The significance between groups at individual timepoints and differences in area under the curve (AOC) were determined. Treatment with the cocktail one day after exposure (Group B) results were confounded by the outlier animal There was not a significant differences in AOC between Group B and Group H suggesting no protection; however, there was also no significant difference in the AOC between Group A and Group I indicating Group B weight loss was not significantly different from the CYP control group that was not exposed. Treatment with the cocktail two days after exposure (Group C) clearly protected. There was significant differences in AOC between Group C and Group H; and no significant difference in the AOC between Group C and Group I. Treatment after three days (Day 3 Group D) did not result in a significant difference in AOC between Group D and H. However, treatment on day 4 or 5 after exposure (Groups E and F, respectively) did significant reduce the AOC relative to Group H. Treatment on day 6 (Group G) was similar to treatment on day 3 where no significant difference in AOR between Group G and H. Although there was no significance in the AOC for the Day 6 treatment group, the last three timepoints weight loss was significantly less than the negative control group. Interestingly, groups administered antibody on Days 3, 4, 5, or 6 started to gain weight starting on Day 9 whereas the negative control antibody treated animals did not. This suggests that there was a benefit of all cocktail treatment even at as late as 6 days post-exposure.

Infectious Virus in Lungs (Day 14/15).

Figure 43C:
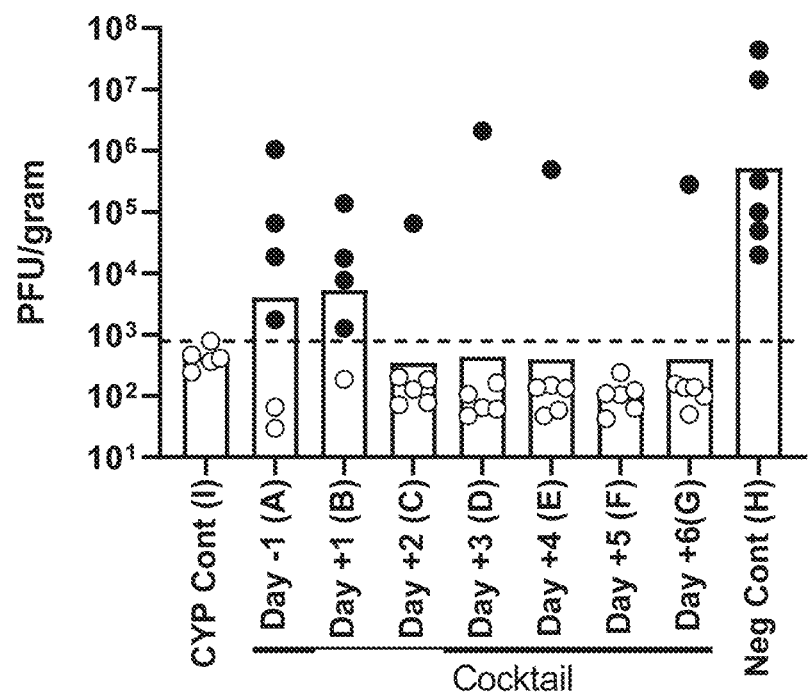
FIG. 43C shows a graph of infectious virus in lungs on Day 14. Plaque assays were run on Day 14 lung homogenates. Plaque forming units (PFU) per gram of tissue were calculated and plotted. The limit of the assay is shown as a dotted line. Bars are the geometric means for each group. Group ID are in parentheses. White symbols indicated no infectious virus was detected. CYP=cyclophosphamide; Neg=Negative; Cont=control.

In wild type hamsters, virus is typically cleared by Day 7. However, in the cyclophosphamide model virus is not suppressed unless there is intervention (e.g. protective antibodies administered) or the cyclophosphamide is discontinued to allow immune response and clearance. Here, our controls demonstrate that unexposed hamsters were negative for virus (Cyp Cont), whereas all hamsters exposed to virus and treated with an off-target monoclonal antibody (Neg Cont) had more than 10,000 pfu of virus per gram of lung tissue. Most of the hamsters treated with the Cocktail one day prior or one day post virus exposure had detectable levels of virus in lung samples collected on Day 14 (Groups A and B). However, almost all of the hamsters treated with antibody >2 day after exposure had undetectable levels of antibody in their lungs. There was only a single animal exception in the Day 2, 3, 4 and 6 treated groups. All of the hamsters treated on Day 5 had lungs that were free of infectious virus. See FIG. 43C.

Sequential Sampling.

Figure 43D:
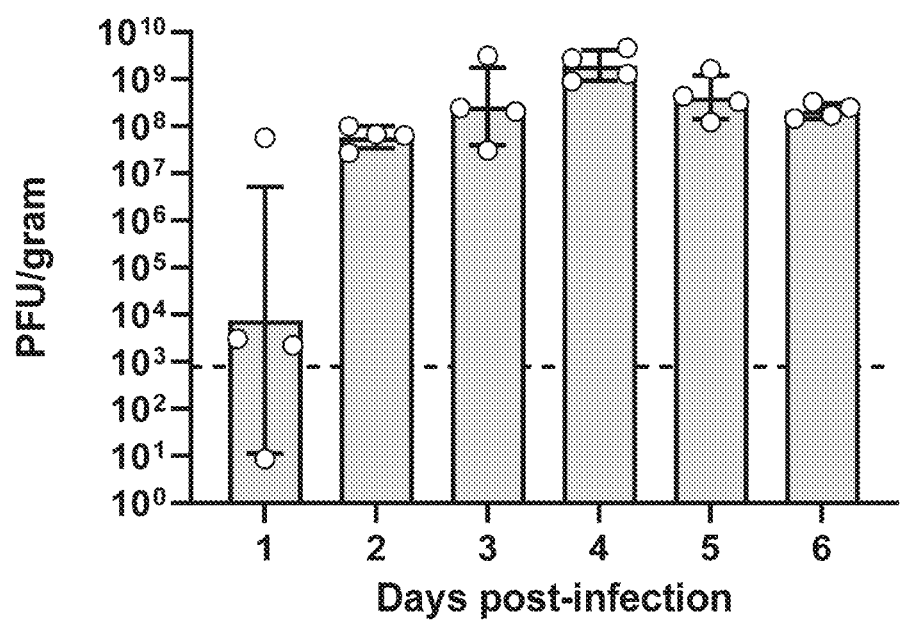
FIG. 43D shows a graph infectious virus in lungs of untreated control hamsters. CYP-treated animals were exposed to 1,000 pfu of virus by intranasal route on Day 0. Groups of four animals were euthanized and lungs were collected on the indicated days. Lung homogenates were assayed for infectious virus by plaque assay. Plaque forming units (PFU) per gram lung tissue are plotted. Geometric mean titers and SD are shown.

Hamsters immunosuppressed and exposed to virus on Day 0 were sampled overtime to monitor the infection. Infectious virus was detected in the lungs of 3 of 4 hamsters on Day 1. Levels of infectious virus then increased more than 4 logs by Day 2. Levels of virus then leveled off and stayed between 7-9 log 10 through the last sampling timepoint (Day 6) analyzed to-date. Thus, animals administered the cocktail after Day 1 likely had very high levels of infectious virus present in their lungs before treatment with the antibody. See FIG. 43D.

Conclusion

The data demonstrates that when administered at or before Day 2 relative to virus exposure, the combination of antibody and nanobody at 20 mg/kg was sufficient to provide convincing benefit as determined by the disease parameters analyzed. When treated after Day 2, animals still developed weight loss but recovered in approximately 4 days. Two weeks after virus exposure, more infectious virus was detected in the lungs of hamsters receiving antibody early (Day −1 or 1) than day 2 or later. Day 2 (or later) treatment of exposed animals occurred at a time when viral burden in the lungs was already remarkably high. CYP, by itself, does not induce weight loss or clinical signs of disease.

Example 14. Immunity Conferred by SARS-CoV-2 and ACE2 Antibodies

Antibodies described in Examples 4-6 are used to confer immunity in a subject. A subject is passively immunized with a SARS-CoV-2 or ACE2 antibody. The subject is then exposed to SARS-CoV-2 after immunization with the SARS-CoV-2 or ACE2 antibody. Exposure can be within a few days or within a few months. The subject can also receive the SARS-CoV-2 or ACE2 antibody immediately following exposure with SARS-CoV-2. Although the subject is exposed to SARS-CoV-2, the subject has developed an immunity against SARS-CoV-2 and infection is prevented.

Example 15. Sequences

Tables 19-41 show exemplary sequences for CDRH1-H3 and CDRL1-L3 as well as variant heavy chains and variant light chains for the SARS-CoV-2 and ACE2 variants.

TABLE 19

ACE2 VHH Variable Heavy Chain CDRs

| Variant | SEQ ID NO | CDRH1 | SEQ ID NO | CDRH2 | SEQ ID NO | CDRH3 |
|---|---|---|---|---|---|---|
| 4-1 | 1 | RTFSDDTMG | 51 | GGISWSGGNTYYA | 101 | CATDPPLFW |
| 4-2 | 2 | RTFGDYIMG | 52 | AAINWSAGYTAYA | 102 | CARASPNTGWHFDRW |
| 4-3 | 3 | RTFSDDAMG | 53 | AAINWSGGTTRYA | 103 | CATDPPLFW |
| 4-4 | 4 | RTFGDYIMG | 54 | AAINWIAGYTADA | 104 | CAEPSPNTGWHFDHW |
| 4-5 | 5 | RTFSDDTMG | 55 | AAINWSGGNTYYA | 105 | CATDPPLFW |
| 4-6 | 6 | RTFGDDTMG | 56 | AAINWTGGYTPYA | 106 | CATDPPLFW |
| 4-7 | 7 | RTFGDYIMG | 57 | AAINWSGGYTAYA | 107 | CATASPNTGWHFDHW |
| 4-8 | 8 | RTFGDYIMG | 58 | GGINWSGGYTYYA | 108 | CATDPPLFW |
| 4-9 | 9 | RTFGDYIMG | 59 | AAINWSGGYTHYA | 109 | CATDPPLFW |
| 4-10 | 10 | RTFSDDTMG | 60 | AAIHWSGSSTRYA | 110 | CATDPPLFW |
| 4-11 | 11 | RTFGDYAMG | 61 | APINWSGGSTYYA | 111 | CATDPPLFW |
| 4-12 | 12 | RTFGDDTMG | 62 | AAINWSGGNTPYA | 112 | CATDPPLFW |
| 4-13 | 13 | RTFGDDTMG | 63 | AAINWSGDNTHYA | 113 | CATDPPLFW |
| 4-14 | 14 | RTFSDDTMG | 64 | AAINWSGGTTRYA | 114 | CATDPPLFW |
| 4-15 | 15 | RTFSDDTMG | 65 | AAINWSGDSTYYA | 115 | CATDPPLFW |
| 4-16 | 16 | RTFSDYTMG | 66 | AAINWSGGYTYYA | 116 | CATDPPLFW |
| 4-17 | 17 | RTFGDDTMG | 67 | AAINWSGGNTDYA | 117 | CATDPPLFW |
| 4-18 | 18 | RTFGDYIMG | 68 | AAINWSGGYTPYA | 118 | CATDPPLFW |
| 4-19 | 19 | RTFSDDTMG | 69 | AAINWSGGSTYYA | 119 | CATDPPLFW |
| 4-20 | 20 | RTFGDDIMG | 70 | AAIHWSAGYTRYA | 120 | CATDPPLFWGHVDLW |
| 4-21 | 21 | RTFSDDTMG | 71 | AGMTWSGSSTFYA | 121 | CATDPPLFW |
| 4-22 | 22 | RTFGDYIMG | 72 | AAINWSGDNTHYA | 122 | CATDPPLFW |
| 4-23 | 23 | RTFSDDAMG | 73 | AGISWNGGSIYYA | 123 | CATDPPLFW |
| 4-24 | 24 | RTFSDYTMG | 74 | AAINWSGGTTYYA | 124 | CATDPPLFW |
| 4-25 | 25 | GTFSRYAMG | 75 | SAVDSGGSTYYA | 125 | CAASPSLRSAWQW |
| 4-26 | 26 | RTFSDDTMG | 76 | AAVNWSGGSTYYA | 126 | CATDPPLFW |
| 4-27 | 27 | RTFGDYIMG | 77 | AAINWSAGYTAYA | 127 | CARATPNTGWHFDHW |
| 4-28 | 28 | RTFGDDTMG | 78 | AAINWNGGNTHYA | 128 | CATDPPLFW |
| 4-29 | 29 | RTFGDDTMG | 79 | AAINWSGGYTYYA | 129 | CATDPPLFW |
| 4-30 | 30 | RTFGDYTMG | 80 | AAINWTGGYTYYA | 130 | CATDPPLFW |

TABLE 19-continued

ACE2 VHH Variable Heavy Chain CDRs

| Variant | SEQ ID NO | CDRH1 | SEQ ID NO | CDRH2 | SEQ ID NO | CDRH3 |
|---|---|---|---|---|---|---|
| 4-31 | 31 | RTFGDYIMG | 81 | AAINWSAGYTAYA | 131 | CATASPNTGWHFDHW |
| 4-32 | 32 | FTFDDYEMG | 82 | AAISWRGGTTYYA | 132 | CAADRRGLASTRAGDYDW |
| 4-33 | 33 | FTFSRHDMG | 83 | AGINWESGSTNYA | 133 | CAADRGVYGGRWYRTSQYTW |
| 4-34 | 34 | RTFGDYIMG | 84 | AAINWSADYTAYA | 134 | CATDPPLFCWHFDHW |
| 4-35 | 35 | QLANFASYAMG | 85 | AAITRSGSSTVYA | 135 | CATTMNPNPRW |
| 4-36 | 36 | RTFGDYIMG | 86 | AAINWSAGYTAYA | 136 | CATAPPLFCWHFDHW |
| 4-37 | 37 | RTFGDYGMG | 87 | ATINWSGALTHYA | 137 | CATLPFYDFWSGYYTGYYYMDVW |
| 4-38 | 38 | RTFSDDTMG | 88 | AAITWSGGRTRYA | 138 | CATDRPLFW |
| 4-39 | 39 | RTFSNAAMG | 89 | ARILWTGASRNYA | 139 | CATTENPNPRW |
| 4-40 | 40 | RTFSDDTMG | 90 | AGINWSGNGVYYA | 140 | CATDPPLFW |
| 4-41 | 41 | RTFGDYIMG | 91 | AAINWSGGTTPYA | 141 | CATDPPLFCCHVDLW |
| 4-42 | 42 | RTFGDDTMG | 92 | AAINWSGGYTPYA | 142 | CATDPPLFWGHVDLW |
| 4-43 | 43 | RTFSDDTMG | 93 | AAINWSGGSTDYA | 143 | CATDPPLFW |
| 4-44 | 44 | RTFGDYIMG | 94 | AAINWSAGYTAYA | 144 | CATARPNTGWHFDHW |
| 4-45 | 45 | RTFSDDAMG | 95 | AAINWSGGSTRYA | 145 | CATDPPLFW |
| 4-46 | 46 | RTFGDYIMG | 96 | AAINWSAGYTPYA | 146 | CATDPPLFWGHVDLW |
| 4-47 | 47 | FTFGDYVMG | 97 | AAINWNAGYTAYA | 147 | CAKASPNTGWHFDHW |
| 4-48 | 48 | RTFSDDAMG | 98 | GRINWSGGNTYYA | 148 | CATDPPLFW |
| 4-49 | 49 | RTFGDYIMG | 99 | AAINWSAGYTAYA | 149 | CARASPNTGWHFDHW |
| 4-50 | 50 | GTFSNSGMG | 100 | AVVNWSGRRTYYA | 150 | CAVPWMDYNRRDW |

TABLE 20

SARS-CoV-2 S1 Variable Heavy Chain CDRs

| Variant | SEQ ID NO | CDRH1 | SEQ ID NO | CDRH2 | SEQ ID NO | CDRH3 |
|---|---|---|---|---|---|---|
| 2-1 | 151 | FTFSNYATD | 166 | SIISGSGGATYYA | 181 | CAKGGYCSSDTCWWEYWLDPW |
| 2-2 | 152 | FTFSRHAMN | 167 | SGISGSGDETYYA | 182 | CARDLPASYYDSSGYYWHNGMDVW |
| 2-3 | 153 | FTFSDFAMA | 168 | SAISGSGDITYYA | 183 | CAREADCLPSPWYLDLW |
| 2-4 | 154 | FTFSDFAMA | 169 | SAITGTGDITYYA | 184 | CAREADGLHSPW |
| 2-5 | 155 | FTFSDFAMA | 170 | SAISGSGDITYYA | 185 | CAREADGLHSPWHFDLW |
| 2-6 | 156 | FTFSDFAMA | 171 | SAISGSGDITYYA | 186 | CAREADGLHSPWHFDLW |
| 2-7 | 157 | FTFSDFAMA | 172 | SAITGSGDITYYA | 187 | CAREADGLHSPWHFDLW |
| 2-8 | 158 | FTFSDFAMA | 173 | SAISGSGDITYYA | 188 | CAREADGLHSPWHFDLW |
| 2-9 | 159 | FTFPRYAMS | 174 | STISGSGSTTYYA | 189 | CARLIDAFDIW |
| 2-10 | 160 | FTFSAFAMG | 175 | SAITASGDITYYA | 190 | CARQSDGLPSPWHFDLG |

TABLE 20-continued

SARS-CoV-2 S1 Variable Heavy Chain CDRs

| Variant | SEQ ID NO | CDRH1 | SEQ ID NO | CDRH2 | SEQ ID NO | CDRH3 |
|---|---|---|---|---|---|---|
| 2-11 | 161 | FTFSNYPMN | 176 | STISGSGGNTFYA | 191 | CVRHDEYSFDYW |
| 2-12 | 162 | FTFSDYPMN | 177 | STISGSGGITFYA | 192 | CVRHDEYSFDYW |
| 2-13 | 163 | FTFSDYPMN | 178 | SAISGSGDNTYYA | 193 | CVRHDEYSFDYW |
| 2-14 | 164 | FTFSDYPMN | 179 | SAITGSGDITYYA | 194 | CVRHDEYSFDYW |
| 2-15 | 165 | FTFSDYPMN | 180 | STISGSGGITFYA | 195 | CVRHDEYSFDYW |

TABLE 21

SARS-CoV-2 S1 Variable Light Chain CDRs

| Variant | SEQ ID NO | CDRL1 | SEQ ID NO | CDRL2 | SEQ ID NO | CDRL3 |
|---|---|---|---|---|---|---|
| 2-1 | 196 | RASQSIHRFLN | 211 | AASNLHS | 226 | CQQSYGLPPTF |
| 2-2 | 197 | RASQTINTYLN | 212 | SASTLQS | 227 | CQQSYSTFTF |
| 2-3 | 198 | RASQNIHTYLN | 213 | AASTFAK | 228 | CQQSYSAPPYTF |
| 2-4 | 199 | RA5Q5IDTYLN | 214 | AASALAS | 229 | CQQSYSAPPYTF |
| 2-5 | 200 | RASQSIHTYLN | 215 | AASALAS | 230 | CQQSYSAPPYTF |
| 2-6 | 201 | RASQSIDTYLN | 216 | AASALAS | 231 | CQQSYSAPPYTF |
| 2-7 | 202 | RASQSIDTYLN | 217 | AASALAS | 232 | CQQSYSAPPYTF |
| 2-8 | 203 | RASQSIDTYLN | 218 | AASALAS | 233 | CQQSYSAPPYTF |
| 2-9 | 204 | RASQRIGTYLN | 219 | AASNLEG | 234 | CQQNYSTTWTF |
| 2-10 | 205 | RASQSIHISLN | 220 | LASPLAS | 235 | CQQSYSAPPYTF |
| 2-11 | 206 | RASQSIGNYLN | 221 | GVSSLQS | 236 | CQQSHSAPLTF |
| 2-12 | 207 | RASQSIDNYLN | 222 | GVSALQS | 237 | CQQSHSAPPYFF |
| 2-13 | 208 | RASQSIDTYLN | 223 | GASALES | 238 | CQQSHSAPPYFF |
| 2-14 | 209 | RASQSIDTYLN | 224 | GVSALQS | 239 | CQQSYSAPPYFF |
| 2-15 | 210 | RASQSIDNYLN | 225 | GVSALQS | 240 | CQQSHSAPLTF |

TABLE 22

ACE2 Variable Heavy Chain CDRs

| Variant | SEQ ID NO | CDRH1 | SEQ ID NO | CDRH2 | SEQ ID NO | CDRH3 |
|---|---|---|---|---|---|---|
| 3-1 | 241 | FMFGNYAMS | 256 | AAISGSGGSTYYA | 271 | CAKDRGYSSSWYGGFDYW |
| 3-2 | 242 | FTFRSHAMN | 257 | SAISGSGGSTNYA | 272 | CARGLKFLEWLPSAFDIW |
| 3-3 | 243 | FTFRNYAMA | 258 | SGISGSGGTTYYG | 273 | CARGTRFLEWSLPLDVW |
| 3-4 | 244 | FTFRNHAMA | 259 | SGISGSGGTTYYG | 274 | CARGTRFLQWSLPLDVW |
| 3-5 | 245 | FTITNYAMS | 260 | SGISGSGAGTYYA | 275 | CARHAWWKGAGFFDHW |
| 3-6 | 246 | FTIPNYAMS | 261 | SGISGAGASTYYA | 276 | CARHTWWKGAGFFDHW |
| 3-7 | 247 | FTIPNYAMS | 262 | SGISGSGASTYYA | 277 | CARHTWWKGAGFFDHW |
| 3-8 | 248 | FTITNYAMS | 263 | SGISGSGASTYYA | 278 | CARHTWWKGAGFFDHW |
| 3-9 | 249 | FTITNYAMS | 264 | SGISGSGAGTYYA | 279 | CARHTWWKGAGFFDHW |
| 3-10 | 250 | FTFRSHAMS | 265 | SSISGGGASTYYA | 280 | CARVKYLTTSSGWPRPYFDNW |
| 3-11 | 251 | FTIRNYAMS | 266 | SSISGGGASTYYA | 281 | CARVKYLTTSSGWPRPYFDNW |
| 3-12 | 252 | FTFRSHAMS | 267 | SSISGGGASTYYA | 282 | CARVKYLTTSSGWPRPYFDNW |
| 3-13 | 253 | FTFRSHAMS | 268 | SSISGGGASTYYA | 283 | CARVKYLTTSSGWPRPYFDNW |

TABLE 22-continued

ACE2 Variable Heavy Chain CDRs

| Variant | SEQ ID NO | CDRH1 | SEQ ID NO | CDRH2 | SEQ ID NO | CDRH3 |
|---|---|---|---|---|---|---|
| 3-14 | 254 | FTFRSYAMS | 269 | SSISGGGASTYYA | 284 | CARVKYLTTSSGWPRPYFDNW |
| 3-15 | 255 | FTFSAYSMS | 270 | SAISGSGGSRYYA | 285 | CGRSKWPQANGAFDIW |

TABLE 23

ACE2 Variable Light Chain CDRs

| Name | SEQ ID NO | CDRL1 | SEQ ID NO | CDRL2 | SEQ ID NO | CDRL3 |
|---|---|---|---|---|---|---|
| 3-1 | 286 | RASQTIYSYLN | 301 | ATSTLQG | 316 | CQHRGTF |
| 3-2 | 287 | RTSQSINTYLN | 302 | GASNVQS | 317 | CQQSYRIPRTF |
| 3-3 | 288 | RASRSISRYLN | 303 | AASSLQA | 318 | CQQSYSSLLTF |
| 3-4 | 289 | RASRSIRRYLN | 304 | ASSSLQA | 319 | CQQSYSTLLTF |
| 3-5 | 290 | RASQSIGRYLN | 305 | AASSLKS | 320 | CQQSYSLPRTF |
| 3-6 | 291 | RASQSIGKYLN | 306 | ASSSLQS | 321 | CQQSYSPPFTF |
| 3-7 | 292 | RASQSIGRYLN | 307 | ASSSLQS | 322 | CQQSYSLPRTF |
| 3-8 | 293 | RASQSIGRYLN | 308 | AASSLKS | 323 | CQQSYSLPLTF |
| 3-9 | 294 | RASQSIGRYLN | 309 | AASSLKS | 324 | CQQSYSLPRTF |
| 3-10 | 295 | RASQSIRKYLN | 310 | ASSTLQR | 325 | CQQSLSTPFTF |
| 3-11 | 296 | RASQSIGKYLN | 311 | ASSTLQR | 326 | CQQSLSPPFTF |
| 3-12 | 297 | RASQSIGKYLN | 312 | ASSTLQR | 327 | CQQSLSTPFTF |
| 3-13 | 298 | RASQSIGKYLN | 313 | ASSTLQR | 328 | CQQSFSPPFTF |
| 3-14 | 299 | RASQSIGKYLN | 314 | ASSTLQR | 329 | CQQSFSTPFTF |
| 3-15 | 300 | RASQNIKTYLN | 315 | AASKLQS | 330 | CQQSYSTSPTF |

TABLE 24

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 2-1 | 331 | FTFSNYATD | 358 | SIISGSGGATYYA | 385 | CAKGGYCSSDTCWWEYWLDPW |
| 2-10 | 332 | FTFSAFAMG | 359 | SAITASGDITYYA | 386 | CARQSDGLPSPWHFDLG |
| 2-5 | 333 | FTFSDFAMA | 360 | SAISGSGDITYYA | 387 | CAREADGLHSPWHFDLW |
| 2-2 | 334 | FTFSRHAMN | 361 | SGISGSGDETYYA | 388 | CARDLPASYYDSSGYYWHNGMDVW |
| 2-4 | 335 | FTFSDFAMA | 362 | SAISGSGDITYYA | 389 | CAREADGLHSPWHFDLW |
| 2-6 | 336 | FTFSNYPMN | 363 | STISGSGGNTFYA | 390 | CVRHDEYSFDYW |
| 2-11 | 337 | FTFSDFAMA | 364 | SAITGSGDITYYA | 391 | CAREADGLHSPWHFDLW |
| 2-12 | 338 | FTFSDYPMN | 365 | STISGSGGITFYA | 392 | CVRHDEYSFDYW |
| 2-13 | 339 | FTFSDYPMN | 366 | SAISGSGDNTYYA | 393 | CVRHDEYSFDYW |
| 2-14 | 340 | FTFSDFAMA | 367 | SAITGTGDITYYA | 394 | CAREADGLHSPW |
| 2-7 | 341 | FTFSDYPMN | 368 | SAITGSGDITYYA | 395 | CVRHDEYSFDYW |
| 2-8 | 342 | FTFSDFAMA | 369 | SAISGSGDITYYA | 396 | CAREADGLHSPWHFDLW |
| 2-15 | 343 | FTFSDFAMA | 370 | SAISGSGDITYYA | 397 | CAREADGLHSPWHFDLW |
| 2-9 | 344 | FTFPRYAMS | 371 | STISGSGSTTYYA | 398 | CARLIDAFDIW |
| 2-16 | 345 | FTFSSYAMS | 372 | SVISGSGGSTYYA | 399 | CAREGYRDYLWYFDLW |
| 2-17 | 346 | FTFSNYAMS | 373 | SAISGSAGSTYYA | 400 | CARVRQGLRRTWYYFDYW |
| 2-18 | 347 | FTFSSYAMY | 374 | SAISGSAGSTYYA | 401 | CARDTNDFWSGYSIFDPW |

TABLE 24-continued

SARS-CoV-2 S1 Variable Heavy Chain CDRs

| Name | SEQ ID NO | CDRH1 | SEQ ID NO | CDR

TABLE 26-continued

SARS-CoV-2 S1 Variant Sequences Variable Heavy Chain

| Name | SEQ ID NO | Amino Acid Sequence |
|---|---|---|
| 2-10 | 494 | EVQLLESGGGLVQPGGSLRLSCAASGFTFSAFAMGWVRQAPGKGLEWVSAITAS GDITYYADSVKGRFTISRDNSKNTLYLQMNSLRAEDTAVYYCARQSDGLPSPWH FDLGGQGTLVTVSS |
| 2-5 | 495 | EVQLLESGGGLVQPGGSLRLSCAASGFTFSDFAMAWVRQAPGKGLEWVSAISGS GDITYYADSVKGRFTISRDNSKNTLYLQMNSLRAEDTAVYYCAREADGLHSPW HFDLWGQGTLVTVSS |
| 2-2 | 496 | EVQLLESGGGLVQPGGSLRLSCAASGFTFSRHAMNWVRQAPGKGLEWVSGISG SGDETYYADSVKGRFTISRDNSKNTLYLQMNSLRAEDTAVYYCARDLPASYYD SSGYYWHNGMDVWGQGTLVTVSS |
| 2-4 | 497 | EVQLLESGGGLVQPGGSLRLSCAASGFTFSDFAMAWVRQAPGKGLEWVSAISGS GDITYYADSVKGRFTISRDNSKNTLYLQMNSLRAEDTAVYYCAREADGLHSPW HFDLWGQGTLVTVSS |
| 2-6 | 498 | EVQLLESGGGLVQPGGSLRLSCAASGFTFSNYPMNWVRQAPGKGLEWVSTISGS GGNTFYADSVKGRFTISRDNSKNTLYLQMNSLRAEDTAVYYCVRHDEYSFDYW GQGTLVTVSS |
| 2-11 | 499 | EVQLLESGGGLVQPGGSLRLSCAASGFTFSDFAMAWVRQAPGKGLEWVSAITGS GDITYYADSVKGRFTISRDNSKNTLYLQMNSLRAEDTAVYYCAREADGLHSPW HFDLWGQGTLVTVSS |
| 2-12 | 500 | EVQLLESGGGLVQPGGSLRLSCAASGFTFSDYPMNWVRQAPGKGLEWVSTISGS GGITFYADSVKGRFTISRDNSKNTLYLQMNSLRAEDTAVYYCVRHDEYSFDYW GQGTLVTVSS |
| 2-13 | 501 | EVQLLESGGGLVQPGGSLRLSCAASGFTFSDYPMNWVRQAPGKGLEWVSAISGS GDNTYYADSVKGRFTISRDNSKNTLYLQMNSLRAEDTAVYYCVRHDEYSFDYW GQGTLVTVSS |
| 2-14 | 502 | EVQLLESGGGLVQPGGSLRLSCAASGFTFSDFAMAWVRQAPGKGLEWVSAITG TGDITYYADSVKGRFTISRDNSKNTLYLQMNSLRAEDTAVYYCAREADGLHSP WGQGTLVTVSS |
| 2-7 | 503 | EVQLLESGGGLVQPGGSLRLSCAASGFTFSDYPMNWVRQAPGKGLEWVSAITGS GDITYYADSVKGRFTISRDNSKNTLYLQMNSLRAEDTAVYYCVRHDEYSFDYW GQGTLVTVSS |
| 2-8 | 504 | EVQLLESGGGLVQPGGSLRLSCAASGFTFSDFAMAWVRQAPGKGLEWVSAISGS GDITYYADSVKGRFTISRDNSKNTLYLQMNSLRAEDTAVYYCAREADGLHSPW HFDLWGQGTLVTVSS |
| 2-15 | 505 | EVQLLESGGGLVQPGGSLRLSCAASGFTFSDFAMAWVRQAPGKGLEWVSAISGS GDITYYADSVKGRFTISRDNSKNTLYLQMNSLRAEDTAVYYCAREADGLHSPW HFDLWGQGTLVTVSS |
| 2-9 | 506 | EVQLLESGGGLVQPGGSLRLSCAASGFTFPRYAMSWVRQAPGKGLEWVSTISGS GSTTYYADSVKGRFTISRDNSKNTLYLQMNSLRAEDTAVYYCARLIDAFDIWGQ GTLVTVSS |
| 2-16 | 507 | EVQLLESGGGLVQPGGSLRLSCAASGFTFSSYAMSWVRQAPGKGLEWVSVISGS GGSTYYADSVKGRFTISRDNSKNTLYLQMNSLRAEDTAVYYCAREGYRDYLWY FDLWGQGTLVTVSS |
| 2-17 | 508 | EVQLLESGGGLVQPGGSLRLSCAASGFTFSNYAMSWVRQAPGKGLEWVSAISGS AGSTYYADSVKGRFTISRDNSKNTLYLQMNSLRAEDTAVYYCARVRQGLRRTW YYFDYWGQGTLVTVSS |
| 2-18 | 509 | EVQLLESGGGLVQPGGSLRLSCAASGFTFSSYAMYWVRQAPGKGLEWVSAISGS AGSTYYADSVKGRFTISRDNSKNTLYLQMNSLRAEDTAVYYCARDTNDFWSGY SIFDPWGQGTLVTVSS |
| 2-19 | 510 | EVQLLESGGGLVQPGGSLRLSCAASGFTFSSYTMSWVRQAPGKGLEWVSVISGS GGSTYYADSVKGRFTISRDNSKNTLYLQMNSLRAEDTAVYYCAREGYRDYLWY FDLWGQGTLVTVSS |
| 2-2 | 511 | EVQLLESGGGLVQPGGSLRLSCAASGFTFSSYDMSWVRQAPGKGLEWVSVISGS GGSTYYADSVKGRFTISRDNSKNTLYLQMNSLRAEDTAVYYCAKGPLVGWYFD LWGQGTLVTVSS |

TABLE 26-continued

SARS-CoV-2 S1 Variant Sequences Variable Heavy Chain

| Name | SEQ ID NO | Amino Acid Sequence |
|---|---|---|
| 2-21 | 512 | EVQLLESGGGLVQPGGSLRLSCAASGFTFPRYAMSWVRQAPGKGLEWVSTISGSGSTTYYADSVKGRFTISRDNSKNTLYLQMNSLRAEDTAVYYCARLIDAFDIWGQGTLVTVSS |
| 2-22 | 513 | EVQLLESGGGLVQPGGSLRLSCAASGFTFTTYALSWVRQAPGKGLEWVSGISGSGDETYYADSVKGRFTISRDNSKNTLYLQMNSLRAEDTAVYYCTTGDDFWSGGNWFDPWGQGTLVTVSS |
| 2-23 | 514 | EVQLLESGGGLVQPGGSLRLSCAASGFTFSRHAMNWVRQAPGKGLEWVSGITGSGDETYYADSVKGRFTISRDNSKNTLYLQMNSLKAEDTAVYYCARDLPASYYDSSGYYWHNGMDVWGQGTLVTVSS |
| 2-24 | 515 | EVQLLESGGGLVQPGGSLRLSCAASGFVFSSYAMSWVRQAPGKGLEWVSAISGSGGSSYYADSVKGRFTISRDNSKNTLYLQMNSLRAEDTAVYYCARVGGGYWYGIDVWGQGTLVTVSS |
| 2-25 | 516 | EVQLLESGGGLVQPGGSLRLSCAASGFTLSSYVMSWVRQAPGKGLEWVSGISGGGASTYYADSVKGRFTISRDNSKNTLYLQMNSLRAEDTAVYYCARGYSRNWYPSWFDPWGQGTLVTVSS |
| 2-26 | 517 | EVQLLESGGGLVQPGGSLRLSCAASGFTFSTYAMSWVRQAPGKGLEWVSSIGGSGSTTYYADSVKGRFTISRDNSKNTLYLQMNSLRAEDTAVYYCAGGWYLDYWGQGTLVTVSS |
| 2-27 | 518 | EVQLLGSGGGLVQPGGSLRLSCAASGFTYSNYAMTWVRQAPGKGLEWVSAISGSSGSTYYADSVKGRFTISRDNSKNTLYLQMNSLRAEDTAVYYCASLCIVDPFDIWGQGTLVTVSS |
| 2-28 | 519 | EVQLLESGGGLVQPGGSLRLSCAASGFTFSNYPMNWVRQAPGKGLEWVSTISGSGGNTFYADSVKGRFTISRDNSKNTLYLQMNSLRAEDTAVYYCVRHDEYSFDYWGQGTLVTVSS |

TABLE 27

SARS-CoV-2 S1 Variant Sequences Variable Light Chain

| Name | SEQ ID NO | Amino Acid Sequence |
|---|---|---|
| 2-1 | 520 | DIQMTQSPSSLSASVGDRVTITCRASQSIHRFLNWYQQKPGKAPKLLIYAASNLHSGVPSRFSGSGSGTDFTLTISSLQPEDFATYYCQQSYGLPP-TFGQGTKVEIK |
| 2-10 | 521 | DIQMTQSPSSLSASVGDRVTITCRASQSIHISLNWYQQKPGKAPKLLIYLASPLASGVPSRFSGSGSGTDFTLTISSLQPEDFATYYCQQSYSAPPYTFGQGTKVEIK |
| 2-5 | 522 | DIQMTQSPSSLSASVGDRVTITCRASQSIHTYLNWYQQKPGKAPKLLIYAASALASGVPSRFSGSGSGTDFTLTISSLQPEDFATYYCQQSYSAPPYTFGQGTKVEIK |
| 2-2 | 523 | DIQMTQSPSSLSASVGDRVTITCRASQTINTYLNWYQQKPGKAPKLLIYSASTLQSGVPSRFSGSGSGTDFTLTISSLQPEDFATYYCQQSYSTFTFGQGTKVEIK |
| 2-4 | 524 | DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK |
| 2-6 | 525 | DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK |
| 2-11 | 526 | DIQMTQSPSSLSASVGDRVTITCRASQSIGNYLNWYQQKPGKAPKLLIYGVSSLQSGVPSRFSGSGSGTDFTLTISSLQPEDFATYYCQQSHSAPLTFGQGTKVEIK |
| 2-12 | 527 | DIQMTQSPSSLSASVGDRVTITCRASQSIDNYLNWYQQKPGKAPKLLIYGVSALQSGVPSRFSGSGSGTDFTLTISSLQPEDFATYYCQQSHSAPPYFFGQGTKVEIK |
| 2-13 | 528 | DIQMTQSPSSLSASVGDRVTITCRASQSIDTYLNWYQQKPGKAPKLLIYGASALESGVPSRFSGSGSGTDFTLTISSLQPEDFATYYCQQSHSAPPYFFGQGTKVEIK |
| 2-14 | 529 | DIQMTQSPSSLSASVGDRVTITCRASQSIDTYLNWYQQKPGKAPKLLIYGVSALQSGVPSRFSGSGSGTDFTLTISSLQPEDFATYYCQQSYSAPPYFFGQGTKVEIK |

TABLE 27-continued

SARS-CoV-2 S1 Variant Sequences Variable Light Chain

| Name | SEQ ID NO | Amino Acid Sequence |
|---|---|---|
| 2-7 | 530 | DIQMTQSPSSLSASVGDRVTITCRASQSIDTYLNWYQQKPGKAPKLLIYAASALAS GVPSRFSGSGSGTDFTLTISSLQPEDFATYYCQQSYSAPPYTFGQGTKVEIK |
| 2-8 | 531 | DIQMTQSPSSLSASVGDRVTITCRASQSIDTYLNWYQQKPGKAPKLLIYAASALAS GVPSRFSGSGSGTDFTLTISSLQPEDFATYYCQQSYSAPPYTFGQGTKVEIK |
| 2-15 | 532 | DIQMTQSPSSLSASVGDRVTITCRASQSIDNYLNWYQQKPGKAPKLLIYGVSALQS GVPSRFSGSGSGTDFTLTISSLQPEDFATYYCQQSHSAPLTFGQGTKVEIK |
| 2-9 | 533 | DIQMTQSPSSLSASVGDRVTITCRASQRIGTYLNWYQQKPGKAPKLLIYAASNLE GGVPSRFSGSGSGTDFTLTISSLQPEDFATYYCQQNYSTTWTFGQGTKVEIK |
| 2-16 | 534 | DIQMTQSPSSLSASVGDRVTITCTGTSSDVGSYDLVSWYQQKPGKAPKLLIYEGN KRPSGVPSRFSGSGSGTDFTLTISSLQPEDFATYYCCSYAGSSVVFGQGTKVEIK |
| 2-17 | 535 | DIQMTQSPSSLSASVGDRVTITCTGTSSDVGSSNLVSWYQQKPGKAPKLLIYEGSK RPSGVPSRFSGSGSGTDFTLTISSLQPEDFATYYCCSYAGSLYVFGQGTKVEIK |
| 2-18 | 536 | DIQMTQSPSSLSASVGDRVTITCTGTSSDIGSYNLVSWYQQKPGKAPKLLIYEGTK RPSGVPSRFSGSGSGTDFTLTISSLQPEDFATYYCCSYAGSRTYVFGQGTKVEIK |
| 2-19 | 537 | DIQMTQSPSSLSASVGDRVTITCTGTSTDVGSYNLVSWYQQKPGKAPKLLIYEGT KRPSGVPSRFSGSGSGTDFTLTISSLQPEDFATYYCCSYAGSYTSVVFGQGTKVEIK |
| 2-2 | 538 | DIQMTQSPSSLSASVGDRVTITCTGTSSNVGSYNLVSWYQQKPGKAPKLLIYEGT KRPSGVPSRFSGSGSGTDFTLTISSLQPEDFATYYCCSYAGSSSFVVFGQGTKVEIK |
| 2-21 | 539 | DIQMTQSPSSLSASVGDRVTITCRASQSIHTYLNWYQQKPGKAPKLLIYAASALAS GVPSRFSGSGSGTDFTLTISSLQPEDFATYYCQQSYSAPPYTFGQGTKVEIK |
| 2-22 | 540 | DIQMTQSPSSLSASVGDRVTITCRASQSIHTYLNWYQQKPGKAPKLLIYAASALAS GVPSRFSGSGSGTDFTLTISSLQPEDFATYYCQQSYSAPPYTFGQGTKVEIK |
| 2-23 | 541 | DIQMTQSPSSLSASVGDRVTITCRASQTINTFLNWYQQKPGKAPKWYSASTLQS GVPSRFSGSGSGTDFTLTISSLQPEDFATYYCQQSYSTFTFGGGTKVEIK |
| 2-24 | 542 | DIQMTQSPSSLSASVGDRVTITCRASQTIRTYLNWYRQKPGKAPKLLIYDASTLQR GVPSRFSGSGSGTDFTLTISSLQPEDFATYYCQQSYRTPPWTFGGGTKVEIK |
| 2-25 | 543 | DIQMTQSPSSLSASVGDRVTITCRSSQSISSYLNWYQQKPGEAPKLLIYGASRLRSG VPSRFSGSGSGTDFTLTISSLQPEDFATYYCQQGYSAPWTFGGGTKVEIK |
| 2-26 | 544 | DIQMTQSPSSLSASVGDRVTITCRASQSISGSLNWYQQKPGKAPKLLIYAESRLHS GVPSRFSGSGSGTDFTLTISSLQPEDFATYYCQQSYSPPQTFGGGTKVEIK |
| 2-27 | 545 | DIQMTQSPSSLSASVGDRVTITCRASRSISTYLNWYQQKPGKAPKLLIYAASNLQG GVPSRLSGSGSGTDFTLTISSLQPEDFATYYCQQSHSIPRTFGGGTKVEIK |
| 2-28 | 546 | DIQMTQSPSSLSASVGDRVTITCRASQSIHTYLNWYQQKPGKAPKLLIYAASALAS GVPSRFSGSGSGTDFTLTISSLQPEDFATYYCQQSYSAPPYTFGQGTKVEIK |

TABLE 28

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 3-10 | 547 | FTFRSHAMS | 576 | SSISGGGASTYYA | 605 | CARVKYLTTSSGWPRPYFDNW |
| 3-4 | 548 | FTFSAYSMS | 577 | SAISGSGGSRYYA | 606 | CGRSKWPQANGAFDIW |
| 3-7 | 549 | FMFGNYAMS | 578 | AAISGSGGSTYYA | 607 | CAKDRGYSSSWYGGFDYW |
| 3-1 | 550 | FTFRNHAMA | 579 | SGISGSGGTTYYG | 608 | CARGTRFLQWSLPLDVW |
| 3-5 | 551 | FTIPNYAMS | 580 | SGISGAGASTYYA | 609 | CARHTWWKGAGFFDHW |
| 3-6 | 552 | FTFRNYAMA | 581 | SGISGSGGTTYYG | 610 | CARGTRFLEWSLPLDVW |

TABLE 28-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 3-15 | 553 | FTIRNYAMS | 582 | SSISGGGASTYYA | 611 | CARVKYLTTSSGWPRPYFDNW |
| 3-3 | 554 | FTIPNYAMS | 583 | SGISGSGASTYYA | 612 | CARHTWWKGAGFFDHW |
| 3-11 | 555 | FTITNYAMS | 584 | SGISGSGAGTYYA | 613 | CARHAWWKGAGFFDHW |
| 3-8 | 556 | FTFRSHAMS | 585 | SSISGGGASTYYA | 614 | CARVKYLTTSSGWPRPYFDNW |
| 3-2 | 557 | FTITNYAMS | 586 | SGISGSGASTYYA | 615 | CARHTWWKGAGFFDHW |
| 3-12 | 558 | FTFRSHAMN | 587 | SAISGSGGSTNYA | 616 | CARGLKFLEWLPSAFDIW |
| 3-14 | 559 | FTFRSHAMS | 588 | SSISGGGASTYYA | 617 | CARVKYLTTSSGWPRPYFDNW |
| 3-9 | 560 | FTFRSYAMS | 589 | SSISGGGASTYYA | 618 | CARVKYLTTSSGWPRPYFDNW |
| 3-13 | 561 | FTITNYAMS | 590 | SGISGSGAGTYYA | 619 | CARHTWWKGAGFFDHW |
| 3-16 | 562 | FTFTNFAMS | 591 | SAISGRGGGTYYA | 620 | CARDAHGYYYDSSGYDDW |
| 3-17 | 563 | FTFRSYPMS | 592 | STISGSGGITYYA | 621 | CAKGVYGSTVTTCHW |
| 3-18 | 564 | FTLTSYAMS | 593 | SAISGSGVDTYYA | 622 | CARPTNWGFDYW |
| 3-19 | 565 | FTFINYAMS | 594 | STISTSGGNTYYA | 623 | CARADSNWASSAYW |
| 3-2 | 566 | FPFSTYAMS | 595 | SGISVSGGFTYYA | 624 | CARDPYSYGYYYYGMDVW |
| 3-21 | 567 | FTFSTYAMG | 596 | SGISGGGVSTYYA | 625 | CARARNWGPSDYW |
| 3-22 | 568 | FIFSDYAMT | 597 | SAISGSAFYA | 626 | CARDATYSSSWYNWFDPW |
| 3-23 | 569 | FTFSDYAMT | 598 | SDISGSGGSTYYA | 627 | CARGTVTSFDFW |
| 3-24 | 570 | FTFSIYAMG | 599 | SFISGSGGSTYYA | 628 | CAKDYHSASWFSAAADYW |
| 3-25 | 571 | FTFASYAMT | 600 | SAISESGGSTYYA | 629 | CAREGQEYSSGSSYFDYW |
| 3-26 | 572 | FTFSEYAMS | 601 | SAITGSGGSTYYG | 630 | CARGSQTPYCGGDCPETFDYW |
| 3-27 | 573 | FTFDDYAMS | 602 | SGISGGGTSTYYA | 631 | CARDLYSSGWYGFDYW |
| 3-28 | 574 | FTFNNYAMN | 603 | SAISGSVGSTYYA | 632 | CARDNYDFWSGYYTNWFDPW |
| 3-29 | 575 | FTFTNHAMS | 604 | SAISGSGSNIYYA | 633 | CARDSLSVTMGRGVVTYYYYGMDFW |

TABLE 29

ACE2 Variant Sequences Variable Light Chain

| Name | SEQ ID NO | CDRL1 | SEQ ID NO | CDRL2 | SEQ ID NO | CDRL3 |
|---|---|---|---|---|---|---|
| 3-10 | 634 | RASQSIRKYLN | 663 | ASSTLQR | 692 | CQQSLSTPFTF |
| 3-4 | 635 | RASQNIKTYLN | 664 | AASKLQS | 693 | CQQSYSTSPTF |
| 3-7 | 636 | RASQTIYSYLN | 665 | ATSTLQG | 694 | CQHRGTF |
| 3-1 | 637 | RASRSIRRYLN | 666 | ASSSLQA | 695 | CQQSYSTLLTF |
| 3-5 | 638 | RASQSIGKYLN | 667 | ASSSLQS | 696 | CQQSYSPPFTF |
| 3-6 | 639 | RASRSISRYLN | 668 | AASSLQA | 697 | CQQSYSSLLTF |
| 3-15 | 640 | RASQSIGKYLN | 669 | ASSTLQR | 698 | CQQSLSPPFTF |
| 3-3 | 641 | RASQSIGRYLN | 670 | ASSSLQS | 699 | CQQSYSLPRTF |
| 3-11 | 642 | RASQSIGRYLN | 671 | AASSLKS | | |
| 3-8 | 643 | RASQSIGKYLN | 672 | ASSTLQR | 701 | CQQSLSTPFTF |
| 3-2 | 644 | RASQSIGRYLN | 673 | AASSLKS | 702 | CQQSYSLPLTF |
| 3-12 | 645 | RTSQSINTYLN | 674 | GASNVQS | 703 | CQQSYRIPRTF |
| 3-14 | 646 | RASQSIGKYLN | 675 | ASSTLQR | 704 | CQQSFSPPFTF |
| 3-9 | 647 | RASQSIGKYLN | 676 | ASSTLQR | 705 | CQQSFSTPFTF |
| 3-13 | 648 | RASQSIGRYLN | 677 | AASSLKS | 706 | CQQSYSLPRTF |
| 3-16 | 649 | RASQIIGSYLN | 678 | TTSNLQS | 707 | CQQSYITPWTF |
| 3-17 | 650 | RASQSISRYIN | 679 | EASSLES | 708 | CQQSHITPLTF |

TABLE 29-continued

ACE2 Variant Sequences Variable Light Chain

| Name | SEQ ID NO | CDRL1 | SEQ ID NO | CDRL2 | SEQ ID NO | CDRL3 |
|---|---|---|---|---|---|---|
| 3-18 | 651 | RASQSIYTYLN | 680 | SASNLHS | 709 | CQQSDTTPWTF |
| 3-19 | 652 | RASQSIATYLN | 681 | GASSLEG | 710 | CQQTFSSPFTF |
| 3-2 | 653 | RASQNINTYLN | 682 | SASSLQS | 711 | CQQSSLTPWTF |
| 3-21 | 654 | RASQGIATYLN | 683 | YASNLQS | 712 | CQQSYSTRFTF |
| 3-22 | 655 | RASERISNYLN | 684 | TASNLES | 713 | CQQSYTPPRTF |
| 3-23 | 656 | RASQSISSSLN | 685 | AASRLQD | 714 | CQQSYSTPRSF |
| 3-24 | 657 | RASQSISSHLN | 686 | RASTLQS | 715 | CQQTYNTPQTF |
| 3-25 | 658 | RASQSISSYLI | 687 | AASRLHS | 716 | CQQGYNTPRTF |
| 3-26 | 659 | RASPSISTYLN | 688 | TASRLQT | 717 | CQQTYSTPSSF |
| 3-27 | 660 | RASQNIAKYLN | 689 | GASGLQS | 718 | CQQSHSPPITF |
| 3-28 | 661 | RASQSIGTYLN | 690 | AASNLHS | 719 | CQESYSAPYTF |
| 3-29 | 662 | RASQSISPYLN | 691 | KASSLQS | 720 | CQQSSTPYTF |

TABLE 30

ACE2 Variant Sequences Variable Heavy Chain

| Name | SEQ ID NO | Amino Acid Sequence |
|---|---|---|
| 3-10 | 721 | EVQLLESGGGLVQPGGSLRLSCAASGFTFRSHAMSWVRQAPGKGLEWVS SISGGGASTYYADSVKGRFTISRDNSKNTLYLQMNSLRAEDTAVYYCAR VKYLTTSSGWPRPYFDNWGQGTLVTVSS |
| 3-4 | 722 | EVQLLESGGGLVQPGGSLRLSCAASGFTFSAYSMSWVRQAPGKGLEWVS AISGSGGSRYYADSVKGRFTISRDNSKNTLYLQMNSLRAEDTAVYYCGRS KWPQANGAFDIWGQGTLVTVSS |
| 3-7 | 723 | EVQLLESGGGLVQPGGSLRLSCAASGFMFGNYAMSWVRQAPGKGLEWV AAISGSGGSTYYADSVKGRFTISRDNSKNTLYLQMNSLRAEDTAVYYCA KDRGYSSSWYGGFDYWGQGTLVTVSS |
| 3-1 | 724 | EVQLLESGGGLVQPGGSLRLSCAASGFTFRNHAMAWVRQAPGKGLEWV SGISGSGGTTYYGDSVKGRFTISRDNSKNTLYLQMNSLRAEDTAVYYCAR GTRFLQWSLPLDVWGQGTLVTVSS |
| 3-5 | 725 | EVQLLESGGGLVQPGGSLRLSCAASGFTIPNYAMSWVRQAPGKGLEWVS GISGAGASTYYADSVKGRFTISRDNSKNTLYLQMNSLRAEDTAVYYCAR HTWWKGAGFFDHWGQGTLVTVSS |
| 3-6 | 726 | EVQLLESGGGLVQPGGSLRLSCAASGFTFRNYAMAWVRQAPGKGLEWV SGISGSGGTTYYGDSVKGRFTISRDNSKNTLYLQMNSLRAEDTAVYYCAR GTRFLEWSLPLDVWGQGTLVTVSS |
| 3-15 | 727 | EVQLLESGGGLVQPGGSLRLSCAASGFTIRNYAMSWVRQAPGKGLEWVS SISGGGASTYYADSVKGRFTISRDNSKNTLYLQMNSLRAEDTAVYYCAR VKYLTTSSGWPRPYFDNWGQGTLVTVSS |
| 3-3 | 728 | EVQLLESGGGLVQPGGSLRLSCAASGFTIPNYAMSWVRQAPGKGLEWVS GISGSGASTYYADSVKGRFTISRDNSKNTLYLQMNSLRAEDTAVYYCAR HTWWKGAGFFDHWGQGTLVTVSS |
| 3-11 | 729 | EVQLLESGGGLVQPGGSLRLSCAASGFTITNYAMSWVRQAPGKGLEWVS GISGSGAGTYYADSVKGRFTISRDNSKNTLYLQMNSLRAEDTAVYYCAR HAWWKGAGFFDHWGQGTLVTVSS |
| 3-8 | 730 | EVQLLESGGGLVQPGGSLRLSCAASGFTFRSHAMSWVRQAPGKGLEWVS SISGGGASTYYADSVKGRFTISRDNSKNTLYLQMNSLRAEDTAVYYCAR VKYLTTSSGWPRPYFDNWGQGTLVTVSS |
| 3-2 | 731 | EVQLLESGGGLVQPGGSLRLSCAASGFTITNYAMSWVRQAPGKGLEWVS GISGSGASTYYADSVKGRFTISRDNSKNTLYLQMNSLRAEDTAVYYCAR HTWWKGAGFFDHWGQGTLVTVSS |
| 3-12 | 732 | EVQLLESGGGLVQPGGSLRLSCAASGFTFRSHAMNWVRQAPGKGLEWV SAISGSGGSTNYADSVKGRFTISRDNSKNTLYLQMNSLRAEDTAVYYCAR GLKFLEWLPSAFDIWGQGTLVTVSS |
| 3-14 | 733 | EVQLLESGGGLVQPGGSLRLSCAASGFTFRSHAMSWVRQAPGKGLEWVS SISGGGASTYYADSVKGRFTISRDNSKNTLYLQMNSLRAEDTAVYYCAR VKYLTTSSGWPRPYFDNWGQGTLVTVSS |

TABLE 30-continued

ACE2 Variant Sequences Variable Heavy Chain

| Name | SEQ ID NO | Amino Acid Sequence |
|---|---|---|
| 3-9 | 734 | EVQLLESGGGLVQPGGSLRLSCAASGFTFRSYAMSWVRQAPGKGLEWVS<br>SISGGGASTYYADSVKGRFTISRDNSKNTLYLQMNSLRAEDTAVYYCAR<br>VKYLTTSSGWPRPYFDNWGQGTLVTVSS |
| 3-13 | 735 | EVQLLESGGGLVQPGGSLRLSCAASGFTITNYAMSWVRQAPGKGLEWVS<br>GISGSGAGTYYADSVKGRFTISRDNSKNTLYLQMNSLRAEDTAVYYCAR<br>HTWWKGAGFFDHWGQGTLVTVSS |
| 3-16 | 736 | EVQLLESGGGLVQPGGSLRLSCAASGFTFTNFAMSWVRQAPGKGLEWVS<br>AISGRGGGTYYADSVKGRFTISRDNSKNTLYLQMNSLRAEDTAVYYCAR<br>DAHGYYYDSSGYDDWGQGTLVTVSS |
| 3-17 | 737 | EVQLLESGGGLVQPGGSLRLSCAASGFTFRSYPMSWVRQAPGKGLEWVS<br>TISGSGGITYYADSVKGRFTISRDNSKNTLYLQMNSLRAEDTAVYYCAKG<br>VYGSTVTTCHWGQGTLVTVSS |
| 3-18 | 738 | EVQLLESGGGLVQPGGSLRLSCAASGFTLTSYAMSWVRQAPGKGLEWVS<br>AISGSGVDTYYADSVKGRFTISRDNSKNTLYLQMNSLRAEDTAVYYCAR<br>PTNWGFDYWGQGTLVTVSS |
| 3-19 | 739 | EVQLLESGGGLVQPGGSLRLSCAASGFTFINYAMSWVRQAPGKGLEWVS<br>TISTSGGNTYYADSVKGRFTISRDNSKNTLYLQMNSLRAEDTAVYYCARA<br>DSNWASSAYWGQGTLVTVSS |
| 3-2 | 740 | EVQLLESGGGLVQPGGSLRLSCAASGFPFSTYAMSWVRQAPGKGLEWVS<br>GISVSGGFTYYADSVKGRFTISRDNSKNTLYLQMNSLRAEDTAVYYCAR<br>DPYSYGYYYYGMDVWGQGTLVTVSS |
| 3-21 | 741 | EVQLLESGGGLVQPGGSLRLSCAASGFTFSTYAMGWVRQAPGKGLEWVS<br>GISGGGVSTYYADSVKGRFTISRDNSKNTLYLQMNSLRAEDTAVYYCAR<br>ARNWGPSDYWGQGTLVTVSS |
| 3-22 | 742 | EVQLLESGGGLVQPGGSLRLSCAASGFIFSDYAMTWVRQAPGKGLEWVS<br>AISGSAFYADSVKGRFTISRDNSKNTLYLQMNSLRAEDTAVYYCARDAT<br>YSSSWYNWFDPWGQGTLVTVSS |
| 3-23 | 743 | EVQLLESGGGLVQPGGSLRLSCAASGFTFSDYAMTWVRQAPGKGLEWVS<br>DISGSGGSTYYADSVKGRFTISRDNSKNTLYLQMNSLRAEDTAVYYCAR<br>GTVTSFDFWGQGTLVTVSS |
| 3-24 | 744 | EVQLLESGGGLVQPGGSLRLSCAASGFTFSIYAMGWVRQAPGKGLEWVS<br>FISGSGGSTYYADSVKGRFTISRDNSKNTLYLQMNSLRAEDTAVYYCAKD<br>YHSASWFSAAADYWGQGTLVTVSS |
| 3-25 | 745 | EVQLLESGGGLVQPGGSLRLSCAASGFTFASYAMTWVRQAPGKGLEWVS<br>AISESGGSTYYADSVKGRFTISRDNSKNTLYLQMNSLRAEDTAVYYCARE<br>GQEYSSGSSYFDYWGQGTLVTVSS |
| 3-26 | 746 | EVQLLESGGGLVQPGGSLRLSCAASGFTFSEYAMSWVRQAPGKGLEWVS<br>AITGSGGSTYYGDSVKGRFTISRDNSKNTLYLQMNSLRAEDTAVYYCAR<br>GSQTPYCGGDCPETFDYWGQGTLVTVSS |
| 3-27 | 747 | EVQLLESGGGLVQPGGSLRLSCAASGFTFDDYAMSWVRQAPGKGLEWV<br>SGISGGGTSTYYADSVKGRFTISRDNSKNTLYLQMNSLRAEDTAVYYCAR<br>DLYSSGWYGFDYWGQGTLVTVSS |
| 3-28 | 748 | EVQLLESGGGLVQPGGSLRLSCAASGFTFNNYAMNWVRQAPGKGLEWV<br>SAISGSVGSTYYADSVKGRFTISRDNSKNTLYLQMNSLRAEDTAVYYCAR<br>DNYDFWSGYYTNWFDPWGQGTLVTVSS |
| 3-29 | 749 | EVQLLESGGGLVQPGGSLRLSCAASGFTFTNHAMSWVRQAPGKGLEWVS<br>AISGSGSNIYYADSVKGRFTISRDNSKNTLYLQMNSLRAEDTAVYYCARD<br>SLSVTMGRGVVTYYYYGMDFWGQGTLVTVSS |

TABLE 31

ACE2 Variant Sequences Variable Light Chain

| Name | SEQ ID NO | Amino Acid Sequence |
|---|---|---|
| 3-10 | 750 | DIQMTQSPSSLSASVGDRVTITCRASQSIRKYLNWYQQKPGKAPKLLIYASST LQRGVPSRFSGSGSGTDFTLTISSLQPEDFATYYCQQSLSTPFTFGGGTKVEIK |
| 3-4 | 751 | DIQMTQSPSSLSASVGDRVTITCRASRSIRRYLNWYQQKPGKAPKLLIYASSSL QAGVPSRFSGSGSGTDFTLTISSLQPEDFATYYCQQSYSTLLTFGQGTKVEIK |
| 3-7 | 752 | DIQMTQSPSSLSASVGDRVTITCRASQSIGRYLNWYQQKPGKAPKLLIYASSSL QSGVPSRFSGSGSGTDFTLTISSLQPEDFATYYCQQSYSLPRTFGQGTKVEIK |
| 3-1 | 753 | DIQMTQSPSSLSASVGDRVTITCRASQTIYSYLNWYQQKPGKAPKLLIYATST LQGGVPSRFSGSGSGTDFTLTISSLQPEDFATYYCQHRGTFGQGTKVEIK |
| 3-5 | 754 | DIQMTQSPSSLSASVGDRVTITCRASQSIGRYLNWYQQKPGKAPKLLIYAASS LKSGVPSRFSGSGSGTDFTLTISSLQPEDFATYYCQQSYSLPRTFGQGTKVEIK |
| 3-6 | 755 | DIQMTQSPSSLSASVGDRVTITCRASQSIGKYLNWYQQKPGKAPKLLIYASSS LQSGVPSRFSGSGSGTDFTLTISSLQPEDFATYYCQQSYSPPFTFGQGTKVEIK |
| 3-15 | 756 | DIQMTQSPSSLSASVGDRVTITCRASQNIKTYLNWYQQKPGKAPKLLIYAASK LQSGVPSRFSGSGSGTDFTLTISSLQPEDFATYYCQQSYSTSPTFGQGTKVEIK |
| 3-3 | 757 | DIQMTQSPSSLSASVGDRVTITCRASRSISRYLNWYQQKPGKAPKLLIYAASSL QAGVPSRFSGSGSGTDFTLTISSLQPEDFATYYCQQSYSSLLTFGQGTKVEIK |
| 3-11 | 758 | DIQMTQSPSSLSASVGDRVTITCRASQSIGKYLNWYQQKPGKAPKLLIYASST LQRGVPSRFSGSGSGTDFTLTISSLQPEDFATYYCQQSLSPPFTFGQGTKVEIK |
| 3-8 | 759 | DIQMTQSPSSLSASVGDRVTITCRASQSIGRYLNWYQQKPGKAPKLLIYAASS LKSGVPSRFSGSGSGTDFTLTISSLQPEDFATYYCQQSYSLPLTFGQGTKVEIK |
| 3-2 | 760 | DIQMTQSPSSLSASVGDRVTITCRTSQSINTYLNWYQQKPGKAPKWYGASN VQSGVPSRFSGSGSGTDFTLTISSLQPEDFATYYCQQSYRIPRTFGQGTKVEIK |
| 3-12 | 761 | DIQMTQSPSSLSASVGDRVTITCRASQSIGKYLNWYQQKPGKAPKLLIYASST LQRGVPSRFSGSGSGTDFTLTISSLQPEDFATYYCQQSLSTPFTFGQGTKVEIK |
| 3-14 | 762 | DIQMTQSPSSLSASVGDRVTITCRASQSIGKYLNWYQQKPGKAPKLLIYASST LQRGVPSRFSGSGSGTDFTLTISSLQPEDFATYYCQQSFSTPFTFGQGTKVEIK |
| 3-9 | 763 | DIQMTQSPSSLSASVGDRVTITCRASQSIGRYLNWYQQKPGKAPKLLIYAASS LKSGVPSRFSGSGSGTDFTLTISSLQPEDFATYYCQQSYSLPRTFGQGTKVEIK |
| 3-13 | 764 | DIQMTQSPSSLSASVGDRVTITCRASQSIGKYLNWYQQKPGKAPKLLIYASST LQRGVPSRFSGSGSGTDFTLTISSLQPEDFATYYCQQSFSPPFTFGQGTKVEIK |
| 3-16 | 765 | DIQMTQSPSSLSASVGDRVTITCRASQIIGSYLNWYQQKPGKAPKLLIYTTSNL QSGVPSRFSGSGSGTDFTLTISSLQPEDFATYYCQQSYITPWTFGQGTKVEIK |
| 3-17 | 766 | DIQMTQSPSSLSASVGDRVTITCRASQSISRYINWYQQKPGKAPKLLIYEASSL ESGVPSRFSGSGSGTDFTLTISSLQPEDFATYYCQQSHITPLTFGQGTKVEIK |
| 3-18 | 767 | DIQMTQSPSSLSASVGDRVTITCRASQSIYTYLNWYQQKPGKAPKLLIYSASN LHSGVPSRFSGSGSGTDFTLTISSLQPEDFATYYCQQSDTTPWTFGQGTKVEIK |
| 3-19 | 768 | DIQMTQSPSSLSASVGDRVTITCRASQSIATYLNWYQQKPGKAPKLLIYGASS LEGGVPSRFSGSGSGTDFTLTISSLQPEDFATYYCQQTFSSPFTFGQGTKVEIK |
| 3-2 | 769 | DIQMTQSPSSLSASVGDRVTITCRASQNINTYLNWYQQKPGKAPKWYSASS LQSGVPSRFSGSGSGTDFTLTISSLQPEDFATYYCQQSSLTPWTFGQGTKVEIK |
| 3-21 | 770 | DIQMTQSPSSLSASVGDRVTITCRASQGIATYLNWYQQKPGKAPKLLIYYASN LQSGVPSRFSGSGSGTDFTLTISSLQPEDFATYYCQQSYSTRFTFGQGTKVEIK |
| 3-22 | 771 | DIQMTQSPSSLSASVGDRVTITCRASERISNYLNWYQQKPGKAPKLLIYTASN LESGVPSRFSGSGSGTDFTLTISSLQPEDFATYYCQQSYTPPRTFGQGTKVEIK |
| 3-23 | 772 | DIQMTQSPSSLSASVGDRVTITCRASQSISSLNWYQQKPGKAPKLLIYAASRL QDGVPSRFSGSGSGTDFTLTISSLQPEDFATYYCQQSYSTPRSFGQGTKVEIK |
| 3-24 | 773 | DIQMTQSPSSLSASVGDRVTITCRASQSISSHLNWYQQKPGKAPKLLIYRASTL QSGVPSRFSGSGSGTDFTLTISSLQPEDFATYYCQQTYNTPQTFGQGTKVEIK |
| 3-25 | 774 | DIQMTQSPSSLSASVGDRVTITCRASQSISSYLIWYQQKPGKAPKLLIYAASRL HSGVPSRFSGSGSGTDFTLTISSLQPEDFATYYCQQGYNTPRTFGQGTKVEIK |

TABLE 31-continued

ACE2 Variant Sequences Variable Light Chain

| Name | SEQ ID NO | Amino Acid Sequence |
|---|---|---|
| 3-26 | 775 | DIQMTQSPSSLSASVGDRVTITCRASPSISTYLNWYQQKPGKAPKLLIYTASRLQTGVPSRFSGSGSGTDFTLTISSLQPEDFATYYCQQTYSTPSSFGQGTKVEIK |
| 3-27 | 776 | DIQMTQSPSSLSASVGDRVTITCRASQNIAKYLNWYQQKPGKAPKLLIYGASGLQSGVPSRFSGSGSGTDFTLTISSLQPEDFATYYCQQHSPPITFGQGTKVEIK |
| 3-28 | 777 | DIQMTQSPSSLSASVGDRVTITCRASQSIGTYLNWYQQKPGKAPKLLIYAASNLHSGVPSRFSGSGSGTDFTLTISSLQPEDFATYYCQESYSAPYTFGQGTKVEIK |
| 3-29 | 778 | DIQMTQSPSSLSASVGDRVTITCRASQSISPYLNWYQQKPGKAPKLLIYKASSLQSGVPSRFSGSGSGTDFTLTISSLQPEDFATYYCQQSSSTPYTFGQGTKVEIK |

TABLE 32

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-51 | 779 | PGTAIMG | 920 | ARISTSGGSTKYA | 1062 | CARTTVTTPPLIW |
| 4-52 | 780 | RSFSNSVMG | 921 | ARITWNGGSTYYA | 1063 | CATTENPNPRW |
| 4-53 | 781 | RTFGDDTMG | 922 | AAVSWSGSGVYYA | 1064 | CATDPPLFW |
| 4-54 | 782 | RTFSDARMG | 923 | GAVSWSGGTTVYA | 1065 | CATTEDPYPRW |
| 4-49 | 783 | RTFGDYIMG | 924 | AAINWSAGYTAYA | 1066 | CARASPNTGWHFDHW |
| 4-55 | 784 | SGLSINAMG | 925 | AAISWSGGSTYTAYA | 1067 | CAAYQAGWGDW |
| 4-39 | 785 | RTFSNAAMG | 926 | ARILWTGASRNYA | 1068 | CATTENPNPRW |
| 4-56 | 786 | FSLDYYGMG | 927 | AAISWNGDFTAYA | 1069 | CAKRANPTGAYFDYW |
| 4-33 | 787 | FTFSRHDMG | 928 | AGINWESGSTNYA | 1070 | CAADRGVYGGRWYRTSQYTW |
| 4-57 | 788 | LTFRNYAMG | 929 | AAIGSGGYTDYA | 1071 | CAVKPGWVARDPSQYNW |
| 4-25 | 789 | GTFSRYAMG | 930 | SAVDSGGSTYYA | 1072 | CAASPSLRSAWQW |
| 4-58 | 790 | FTLDYYDMG | 931 | AAVTWSGGSTYYA | 1073 | CAADRRGLASTRAADYDW |
| 4-59 | 791 | RTFGDYIMG | 932 | AAINWSAGYTPYA | 1074 | CATAPPLFCWHFDLW |
| 4-6 | 792 | RTFGDDIMG | 933 | AAIHWSAGYTRYA | 1075 | CATDPPLFWGHVDLW |
| 4-61 | 793 | RTFGDYIMG | 934 | AAINWSADYTPYA | 1076 | CATAPPNTGWHFDHW |
| 4-3 | 794 | RTFGDYIMG | 935 | AAINWSAGYTAYA | 1077 | CATATPNTGWHFDHW |
| 4-62 | 795 | RTFSDDTMG | 936 | AAINWSGGSTDYA | 1078 | CATDPPLFW |
| 4-43 | 796 | RTFGDDTMG | 937 | AGINWSGGNTYYA | 1079 | CATDPPLFW |
| 4-5 | 797 | RTFGDYIMG | 938 | AAINWTGGYTSYA | 1080 | CATDPPLFW |
| 4-42 | 798 | RTFGDDTMG | 939 | AAINWSGGNTYYA | 1081 | CATDPPLFW |
| 4-63 | 799 | RTFSDYTMG | 940 | AAINWSGGYTYYA | 1082 | CATDPPLFW |
| 4-6 | 800 | RTFGDYGMG | 941 | ATINWSGALTHYA | 1083 | CATLPFYDFWSGYYTGYYYMDVW |
| 4-40 | 801 | RTFSDDTMG | 942 | AGVTWSGSSTFYA | 1084 | CATDPPLFW |
| 4-21 | 802 | RTFSDDIMG | 943 | AAISWSGGNTHYA | 1085 | CATDPPLFW |
| 4-64 | 803 | RTFGDYIMG | 944 | AAINWSAGYTAYA | 1086 | CATASPNTGWHFDHW |

TABLE 32-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-47 | 804 | FTFDDDYVMG | 945 | AAVSGSGDDTYYA | 1087 | CAADRRGLASTRAADYDW |
| 4-65 | 805 | RTFGDYIMG | 946 | AAINWSAGYTAYA | 1088 | CATEPPLSCWHFDLW |
| 4-18 | 806 | RTFGDYIMG | 947 | AAINWSGGYTPYA | 1089 | CATAPPNTGWHFDHW |
| 4-66 | 807 | RTFGDDTMG | 948 | AAINWSAGYTPYA | 1090 | CATDPPLFCCHFDLW |
| 4-36 | 808 | RTFSDDTMG | 949 | AAISWSGGTTRYA | 1091 | CATDPPLFW |
| 4-67 | 809 | RTFSDDTMG | 950 | AAINWSGDSTYYA | 1092 | CATDPPLFW |
| 4-16 | 810 | RTFSDDTMG | 951 | AAINWSGGTTRYA | 1093 | CATDPPLFW |
| 4-11 | 811 | RTFSDDAMG | 952 | AAIHWSGSSTRYA | 1094 | CATDPPLFW |
| 4-68 | 812 | RTFSDDTMG | 953 | GTINWSGGSTYYA | 1095 | CATDPPLFW |
| 4-34 | 813 | RTFGDYIMG | 954 | AAINWSGGYTPYA | 1096 | CATDPPLFW |
| 4-28 | 814 | RTFDDDTMG | 955 | AAINWNGGNTHYA | 1097 | CATDPPLFW |
| 4-69 | 815 | RTFSDDAMG | 956 | AAINWSGGTTRYA | 1098 | CATDPPLFW |
| 4-7 | 816 | RTFGDYIMG | 957 | AAINWSAGYTPYA | 1099 | CATDPPLFWGHVDLW |
| 4-71 | 817 | RTFSDDTMG | 958 | ASINWSGGSTYYA | 1100 | CATDPPLFW |
| 4-23 | 818 | RTFSDDAMG | 959 | AGISWNGGSIYYA | 1101 | CATDPPLFW |
| 4-9 | 819 | FTFDDYEMG | 960 | AAISWRGGTTYYA | 1102 | CAADRRGLASTRAGDYDW |
| 4-72 | 820 | RTFGDDTMG | 961 | AAINWSGGYTPYA | 1103 | CATDPPLFWGHVDLW |
| 4-73 | 821 | RTFSDDAMG | 962 | AAINWSGGSTRYA | 1104 | CATDPPLFW |
| 4-29 | 822 | VTLDDYAMG | 963 | AVINWSGGSTDYA | 1105 | CARGGGWVPSSTSESLNWYFDRW |
| 4-41 | 823 | RTFGDYIMG | 964 | AAINWSGGTTPYA | 1106 | CATDPPLFCCHVDLW |
| 4-74 | 824 | LTFSDDTMG | 965 | AAVSWSGGNTYYA | 1107 | CATDPPLFW |
| 4-75 | 825 | RTFGDDTMG | 966 | AAINWTGGYTPYA | 1108 | CATDPPLFW |
| 4-31 | 826 | RTFGDYIMG | 967 | ATINWTAGYTYYA | 1109 | CATDPPLFCWHFDHW |
| 4-32 | 827 | RTFGDDTMG | 968 | AAINWSGGNTDYA | 1110 | CATDPPLFW |
| 4-15 | 828 | RTFGDYTMG | 969 | AAINWSGGNTYYA | 1111 | CATDPPLFW |
| 4-14 | 829 | RTFSDDTMG | 970 | AGINWSGNGVYYA | 1112 | CATDPPLFW |
| 4-76 | 830 | RTFGDYAMG | 971 | APINWSGGSTYYA | 1113 | CATDPPLFW |
| 4-50 | 831 | GTFSNSGMG | 972 | AVVNWSGRRTYYA | 1114 | CAVPWMDYNRRDW |
| 4-17 | 832 | QLANFASYAMG | 973 | AAITRSGSSTVYA | 1115 | CATTMNPNPRW |
| 4-37 | 833 | RTFSDDIMG | 974 | AAINWTGGSTYYA | 1116 | CATDPPLFW |
| 4-44 | 834 | RTFGDYIMG | 975 | AAINWSAGYTAYA | 1117 | CATARPNTGWHFDHW |
| 4-77 | 835 | RTFSDDTMG | 976 | GSINWSGGSTYYA | 1118 | CATDPPLFW |
| 4-78 | 836 | RTFSDDTMG | 977 | AGMTWSGSSTFYA | 1119 | CATDPPLFW |
| 4-79 | 837 | RTFGDYIMG | 978 | AAINWSGDYTDYA | 1120 | CATDPPLFW |
| 4-8 | 838 | RTFGDYIMG | 979 | GGINWSGGYTYYA | 1121 | CATDPPLFW |
| 4-81 | 839 | RTFSDDTMG | 980 | AAVNWSGGSTYYA | 1122 | CATDPPLFW |

TABLE 32-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-82 | 840 | RTFGDYAMG | 981 | AAINWSGGYTRYA | 1123 | CATDPPLFW |
| 4-83 | 841 | RTFGDDTMG | 982 | AAINWSGGYTPYA | 1124 | CATDPPLFW |
| 4-35 | 842 | RTFGDYIMG | 983 | AAINWSAGYTAYA | 1125 | CARASPNTGWHFDRW |
| 4-45 | 843 | RTFGDYIMG | 984 | AAINWSGGYTHYA | 1126 | CATDPPLFW |
| 4-84 | 844 | RTFSDDTMG | 985 | AAITWSGGRTRYA | 1127 | CATDRPLFW |
| 4-85 | 845 | RTFGDYIMG | 986 | AAINWSGGYTAYA | 1128 | CATASPNTGWHFDHW |
| 4-86 | 846 | RTFSDDTMG | 987 | AAIHWSGSSTRYA | 1129 | CATDPPLFW |
| 4-87 | 847 | RTFSDYTMG | 988 | AAINWSGGTTYYA | 1130 | CATDPPLFW |
| 4-88 | 848 | RTFGDDTMG | 989 | AAINWSGDNTHYA | 1131 | CATDPPLFW |
| 4-89 | 849 | FAFGDNWIG | 990 | ASISSGGTTAYA | 1132 | CAHRGGWLRPWGYW |
| 4-9 | 850 | RTFSDDAMG | 991 | GRINWSGGNTYYA | 1133 | CATDPPLFW |
| 4-91 | 851 | RTFSDDTMG | 992 | GGISWSGGNTYYA | 1134 | CATDPPLFW |
| 4-92 | 852 | RTFSDDTMG | 993 | AAINWSGGSTYYA | 1135 | CATDPPLFW |
| 4-46 | 853 | RTFGDDTMG | 994 | AAINWSGGYTYYA | 1136 | CATDPPLFW |
| 4-20 | 854 | RTFGDYIMG | 995 | AAINWSADYTAYA | 1137 | CATDPPLFCWHFDHW |
| 4-93 | 855 | RTFSDDAMG | 996 | AAINWSGSSTYYA | 1138 | CATDPPLFW |
| 4-4 | 856 | RTFGDYIMG | 997 | AAINWIAGYTADA | 1139 | CAEPSPNTGWHFDHW |
| 4-2 | 857 | RTFGDDTMG | 998 | AAINWSGGNTPYA | 1140 | CATDPPLFW |
| 4-94 | 858 | RTFSDDTMG | 999 | AAINWSGDNTHYA | 1141 | CATDPPLFW |
| 4-95 | 859 | RTFGDYIMG | 1000 | AAINWSAGYTAYA | 1142 | CATAPPLFCWHFDHW |
| 4-12 | 860 | FTFGDYVMG | 1001 | AAINWNAGYTAYA | 1143 | CAKASPNTGWHFDHW |
| 4-30 | 861 | RTFGDYTMG | 1002 | AAINWTGGYTYYA | 1144 | CATDPPLFW |
| 4-27 | 862 | RTFGDYIMG | 1003 | AAINWSAGYTAYA | 1145 | CARATPNTGWHFDHW |
| 4-22 | 863 | RTFGDYIMG | 1004 | AAINWSGDNTHYA | 1146 | CATDPPLFW |
| 4-96 | 864 | RTFGDYIMG | 1005 | AAINWSAGYTPYA | 1147 | CATDPPLFCCHFDHW |
| 4-97 | 865 | RTFGDYIMG | 1006 | AAINWSAGYTAYA | 1148 | CATAPPNTGWHFDHW |
| 4-98 | 866 | FTWGDYTMG | 1007 | AAINWSGGNTYYA | 1149 | CAADRRGLASTRAADYDW |
| 4-99 | 867 | IPSTLRAMG | 1008 | AAVSSLGPFTRYA | 1150 | CAAKPGWVARDPSQYNW |
| 4-100 | 868 | FSFDDDYVMG | 1009 | AAINWSGGSTYYA | 1151 | CAADRRGLASTRAADYDW |
| 4-101 | 869 | RTFSNAAMG | 1010 | ARILWTGASRSYA | 1152 | CATTENPNPRW |
| 4-102 | 870 | GTFGVYHMG | 1011 | AAINMSGDDSAYA | 1153 | CAILVGPGQVEFDHW |
| 4-103 | 871 | FTFSSYYMG | 1012 | ARISGSTFYA | 1154 | CAALPFVCPSGSYSDYGDEYDW |
| 4-104 | 872 | RTFSGDFMG | 1013 | GRINWSGGNTYYA | 1155 | CPTDPPLFW |
| 4-105 | 873 | STLRDYAMG | 1014 | AAITWSGGSTAYA | 1156 | CASLLAGDRYFDYW |
| 4-106 | 874 | FTFDDYTMG | 1015 | AAITDNGGSKYYA | 1157 | CAADRRGLASTRAADYDW |
| 4-107 | 875 | GTFSSYGMG | 1016 | AAINWSGASTYYA | 1158 | CARDWRDRTWGNSLDYW |
| 4-108 | 876 | FSFDDDYVMG | 1017 | AAISWSEDNTYYA | 1159 | CAADRRGLASTRAADYDW |

TABLE 32-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-109 | 877 | FSFDDDYVMG | 1018 | AAVSGSGDDTYYA | 1160 | CAADRRGLASTRAADYDW |
| 4-110 | 878 | NIAAINVMG | 1019 | AAISASGRRTDYA | 1161 | CARRVYYYDSSGPPGVTFDIW |
| 4-111 | 879 | IITSRYVMG | 1020 | AAISTGGSTIYA | 1162 | CARQDSSSPYFDYW |
| 4-112 | 880 | FSFDDDYVMG | 1021 | AAISNSGLSTYYA | 1163 | CAADRRGLASTRAADYDW |
| 4-113 | 881 | SISSINVMG | 1022 | ATMRWSTGSTYYA | 1164 | CAQRVRGFFGPLRTTPSWYEW |
| 4-114 | 882 | LTFILYRMG | 1023 | AAINNFGTTKYA | 1165 | CARTHYDFWSGYTSRTPNYFDYW |
| 4-115 | 883 | GTFSVYHMG | 1024 | AAISWSGGSTAYA | 1166 | CAAVNTWTSPSFDSW |
| 4-116 | 884 | RAFSTYGMG | 1025 | AGINWSGDTPYYA | 1167 | CAREVGPPPGYFDLW |
| 4-117 | 885 | RTFSDIAMG | 1026 | ASINWGGGNTYYA | 1168 | CAAKGIWDYLGRRDFGDW |
| 4-118 | 886 | RTFSSARMG | 1027 | AAISWSGDNTHYA | 1169 | CATTENPNPRW |
| 4-119 | 887 | FAFSSYAMG | 1028 | ATINGDDYTYYA | 1170 | CVATPGGYGLW |
| 4-120 | 888 | ITFRRHDMG | 1029 | AAIRWSSSTVYA | 1171 | CAADRGVYGGRWYRTSQYTW |
| 4-121 | 889 | TAASFNPMG | 1030 | AAITSGGSTNYA | 1172 | CAAIAYEEGVYRWDW |
| 4-122 | 890 | NINIINYMG | 1031 | AAIHWNGDSTAYA | 1173 | CASGPPYSNYFAYW |
| 4-123 | 891 | FTFDDYAMG | 1032 | AAISGSGGSTAYA | 1174 | CAKIMGSGRPYFDHW |
| 4-124 | 892 | NIFTRNVMG | 1033 | AAITSSGSTNYA | 1175 | CARPSSDLQGGVDYW |
| 4-125 | 893 | RTFSSIAMG | 1034 | ASINWGGGNTIYA | 1176 | CAAKGIWDYLGRRDFGDW |
| 4-126 | 894 | IPSTLRAMG | 1035 | AAVSSLGPFTRYA | 1177 | CAAKPGWVARDPSEYNW |
| 4-127 | 895 | FTLDDSAMG | 1036 | AAITNGGSTYYA | 1178 | CARFARGSPYFDFW |
| 4-128 | 896 | SISSFNAMG | 1037 | AAIDWDGSTAYA | 1179 | CARGGGYYGSGSFEYW |
| 4-129 | 897 | NIFSDNIIG | 1038 | AYYTSGGSIDYA | 1180 | CARGTAVGRPPPGGMDVW |
| 4-130 | 898 | SISSIGAMG | 1039 | AAISSSGSSTVYA | 1181 | CARVPPGQAYFDSW |
| 4-131 | 899 | FTFDDYGMG | 1040 | ATITWSGDSTYYA | 1182 | CAKGGSWYYDSSGYYGRW |
| 4-132 | 900 | RTFSNYTMG | 1041 | SAISWSTGSTYYA | 1183 | CAADRYGPPWYDW |
| 4-133 | 901 | STNYMG | 1042 | AAISMSGDDTIYA | 1184 | CARIGLRGRYFDLW |
| 4-134 | 902 | GTFSSVGMG | 1043 | AVINWSGARTYYA | 1185 | CAVPWMDYNRRDW |
| 4-135 | 903 | RIFTNTAMG | 1044 | AAINWSGGSTAYA | 1186 | CARTSGSYSFDYW |
| 4-136 | 904 | EEFSDHWMG | 1045 | GAIHWSGGRTYYA | 1187 | CAADRRGLASTRAADYDW |
| 4-137 | 905 | RTFSSIAMG | 1046 | AAINWSGARTAYA | 1188 | CAAKGIWDYLGRRDFGDW |
| 4-138 | 906 | STSSLRTMG | 1047 | AAISSRDGSTIYA | 1189 | CARDDSSSPYFDYW |
| 4-139 | 907 | GGTFGSYAMG | 1048 | AAISIASGASGGTTNYA | 1190 | CATTMNPNPRW |
| 4-140 | 908 | RTFSNAAMG | 1049 | ARITWNGGSTFYA | 1191 | CATTENPNPRW |
| 4-141 | 909 | IILSDNAMG | 1050 | AAISWLGESTYYA | 1192 | CAADRRGLASTRAADYDW |
| 4-142 | 910 | RTFGDYIMG | 1051 | AAINWNGGYTAYA | 1193 | CATTSPNTGWHYYRW |

TABLE 32-continued

ACE2 Variable Heavy Chain CDRs

| Name | SEQ ID NO | CDRH1 | SEQ ID NO | CDRH2 | SEQ ID NO | CDRH3 |
|---|---|---|---|---|---|---|
| 4-143 | 911 | FNFNWYPMG | 1052 | AAISWTGVSTYTAYA | 1194 | CARWGPGPAGGSPGLVGFDYW |
| 4-144 | 912 | SIRSVSVMG | 1053 | AAISWSGVGTAYA | 1195 | CAAYQRGWGDW |
| 4-145 | 913 | MTFRLYAMG | 1054 | GAINWLSESTYYA | 1196 | CAAKPGWVARDPSEYNW |
| 4-146 | 914 | RTFSDDAMG | 1055 | AAINWSGGSTYYA | 1197 | CATDPPLFW |
| 4-147 | 915 | GTFSVYAMG | 1056 | AAISMSGDDAAYA | 1198 | CAKISKDDGGKPRGAFFDSW |
| 4-148 | 916 | FALGYYAMG | 1057 | AAISSRDGSTAYA | 1199 | CARLATGPQAYFHHW |
| 4-149 | 917 | FNLDDYAMG | 1058 | AAISWDGGATAYA | 1200 | CARVGRGTTAFDSW |
| 4-150 | 918 | NTFSGGFMG | 1059 | ASIRSGARTYYA | 1201 | CAQRVRGFFGPLRTTPSWYEW |
| 4-151 | 919 | SIRSINIMG | 1060 | AAISWSGGSTVYA | 1202 | CASLLAGDRYFDYW |

TABLE 33

ACE2 Variant Sequences Variable Heavy Chain

| Name | SEQ ID | Amino Acid Sequence |
|---|---|---|
| 4-51 | 1203 | EVQLVESGGGLVQPGGSLRLSCAASGPGTAIMGWFRQAPGKEREFVARISTSGGSTKYADSVKGRFTISADNSKNTAYLQMNSLKPEDTAVYYCARTTVTTPPLIWGQGTLVTVSS |
| 4-52 | 1204 | EVQLVESGGGLVQPGGSLRLSCAASGRSFSNSVMGWFRQAPGKEREFVARITWNGGSTYYADSVKGRFTISADNSKNTAYLQMNSLKPEDTAVYYCATTENPNPRWGQGTLVTVSS |
| 4-53 | 1205 | EVQLVESGGGLVQPGGSLRLSCAASGRTFGDDTMGWFRQAPGKEREFVAAVSWSGSGVYYADSVKGRFTITADNSKNTAYLQMNSLKPENTAVYYCATDPPLFWGQGTLVTVSS |
| 4-54 | 1206 | EVQLVESGGGLVQPGGSLRLSCAASGRTFSDARMGWFRQAPGKEREFVGAVSWSGGTTVYADSVKGRFTISADNSKNTAYLQMNSLKPEDTAVYYCATTEDPYPRWGQGTLVTVSS |
| 4-49 | 1207 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDHWGQGTLVTVSS |
| 4-55 | 1208 | EVQLVESGGGLVQPGGSLRLSCAASGSGLSINAMGWFRQAPGKERESVAAISWSGGSTYTAYADSVKGRFTISADNSKNTAYLQMNSLKPEDTAVYYCAAYQAGWGDWGQGTLVTVSS |
| 4-39 | 1209 | EVQLVESGGGLVQPGGSLRLSCAASGRTFSNAAMGWFRQAPGKEREFVARILWTGASRNYADSVKGRFTISADNSKNTAYLQMNSLKPEDTAVYYCATTENPNPRWGQGTLVTVSS |
| 4-56 | 1210 | EVQLVESGGGLVQPGGSLRLSCAASGFSLDYYGMGWFRQAPGKERESVAAISWNGDFTAYADSVKGRFTISADNSKNTAYLQMNSLKPEDTAVYYCAKRANPTGAYFDYWGQGTLVTVSS |
| 4-33 | 1211 | EVQLVESGGGLVQPGGSLRLSCAASGFTFSRHDMGWFRQAPGKEREFVAGINWESGSTNYADSVKGRFTISADNSKNTAYLQMNSLKPEDTAVYYCAADRGVYGGRWYRTSQYTWGQGTLVTVSS |
| 4-57 | 1212 | EVQLVESGGGLVQPGGSLRLSCAASGLTFRNYAMGWFRQAPGKEREFVAAIGSGGYTDYADSVKGRFTISADNSKNTAYLQMNSLKPEDTAVYYCAVKPGWVARDPSQYNWGQGTLVTVSS |
| 4-25 | 1213 | EVQLVESGGGLVQPGGSLRLSCAASGGTFSRYAMGWFRQAPGKEREWVSAVDSGGSTYYADSVKGRFTISADNSKNTAYLQMNSLKPEDTAVYYCAASPSLRSAWQWGQGTLVTVSS |

TABLE 33-continued

ACE2 Variant Sequences Variable Heavy Chain

| Name | SEQ ID | Amino Acid Sequence |
|---|---|---|
| 4-58 | 1214 | EVQLVESGGGLVQPGGSLRLSCAASGFTLDYYDMGWFRQAPGKEREFVAAVTWSGG STYYADSVKGRFTISADNSKNTAYLQMNSLKPEDTAVYYCAADRRGLASTRAADYD WGQGTLVTVSS |
| 4-59 | 1215 | EVQLVESGGGLVQPGGSLRLSCAASGRTFGDYIMGWFRQAPGKEREFVAAINWSAG YTPYADSVKGRFTISADNSKNTAYLQMNSLKPEDTAVYYCATAPPLFCWHFDLWGQ GTLVTVSS |
| 4-6 | 1216 | EVQLVESGGGLVQPGGSLRLSCAASGRTFGDDIMGWFRQAPGKEREFVAAIHWSAG YTRYADSVKGRFTISADNSKNTAYLQMNSLKPEDTAVYYCATDPPLFWGHVDLWGQ GTLVTVSS |
| 4-61 | 1217 | EVQLVESGGGLVQPGGSLRLSCAASGRTFGDYIMGWFRQAPGKEREIVAAINWSADY TPYADSVKGRFTISADNSKNTAYLQMNSLKPEDTAVYYCATAPPNTGWHFDHWGQG TLVTVSS |
| 4-3 | 1218 | EVQLVESGGGLVQPGGSLRLSCAASGRTFGDYIMGWFRQAPGKEREIVAAINWSAGY TAYADSVKGRFTISADNSKNTAYLQMNSLKPEDTAVYYCATATPNTGWHFDHWGQ GTLVTVSS |
| 4-62 | 1219 | EVQLVESGGGLVQPGGSLRLSCAASGRTFSDDTMGWFRQAPGKEREFVAAINWSGG STDYADSVKGRFTISADNSKNTAYLQMNSLKPEDTAVYYCATDPPLFWGQGTLVTVS S |
| 4-43 | 1220 | EVQLVESGGGLVQPGGSLRLSCAASGRTFGDDTMGWFRQAPGKEREFVAGINWSGG NTYYADSVKGRFTISADNSKNTAYLQMNSLKPEDTAVYYCATDPPLFWGQGTLVTV SS |
| 4-5 | 1221 | EVQLVESGGGLVQPGGSLRLSCAASGRTFGDYIMGWFRQAPGKEREFVAAINWTGG YTSYADSVKGRFTISADNSKNTAYLQMNSLKPEDTAVYYCATDPPLFWGQGTLVTVS S |
| 4-42 | 1222 | EVQLVESGGGLVQPGGSLRLSCAASGRTFGDDTMGWFRQAPGKERECVAAINWSGG NTYYADSVKGRFTISADNSKNTAYLQMNSLKPEDTAVYYCATDPPLFWGQGTLVTV SS |
| 4-63 | 1223 | EVQLVESGGGLVQPGGSLRLSCAASGRTFSDYTIMGWFRQAPGKEREFVAAINWSGG YTYYADSVKGRFTISADNSKNTAYLQMNSLKPEDTAVYYCATDPPLFWGQGTLVTV SS |
| 4-6 | 1224 | EVQLVESGGGLVQPGGSLRLSCAASGRTFGDYGMGWFRQAPGKEREFVATINWSGA LTHYADSVKGRFTISADNSKNTAYLQMNSLKPEDTAVYYCATLPFYDFWSGYYTGY yymdvwgqgtlvtvss |
| 4-40 | 1225 | EVQLVESGGGLVQPGGSLRLSCAASGRTFSDDTMGWFRQAPGKEREFLAGVTWSGS STFYADSVKGRFTISADNSKNTAYLQMNSLKPEDTAVYYCATDPPLFWGQGTLVTVS S |
| 4-21 | 1226 | EVQLVESGGGLVQPGGSLRLSCAASGRTFSDDIMGWFRQAPGKEREFVAAISWSGGN THYADSVKGRFTISADNSKNTAYLQMNSLKPEDTAVYYCATDPPLFWGQGTLVTVSS |
| 4-64 | 1227 | EVQLVESGGGLVQPGGSLRLSCAASGRTFGDYIMGWFRQAPGKERESVAAINWSAG YTAYADSVKGRFTISADNSKNTAYLQMNSLKPEDTAVYYCATASPNTGWHFDHWG QGTLVTVSS |
| 4-47 | 1228 | EVQLVESGGGLVQPGGSLRLSCAASGFTFDDDYVMGWFRQAPGKEREFVAAVSGSG DDTYYADSVKGRFTISADNSKNTAYLQMNSLKPEDTAVYYCAADRRGLASTRAADY DWGQGTLVTVSS |
| 4-65 | 1229 | EVQLVESGGGLVQPGGSLRLSCAASGRTFGDYIMGWFRQAPGKEREFVAAINWSAG YTAYADSVKGRFTISADNSKNTAYLQMNSLKPEDTAVYYCATEPPLSCWHFDLWGQ GTLVTVSS |
| 4-18 | 1230 | EVQLVESGGGLVQPGGSLRLSCAASGRTFGDYIMGWFRQAPGKEREIVAAINWSGGY TPYADSVKGRFTISADNSKNTAYLQMNSLKPEDTAVYYCATAPPNTGWHFDHWGQG TLVTVSS |
| 4-66 | 1231 | EVQLVESGGGLVQPGGSLRLSCAASGRTFGDDTMGWFRQAPGKEREIVAAINWSAG YTPYADSVKGRFTISADNSKNTAYLQMNSLKPEDTAVYYCATDPPLFCCHFDLWGQ GTLVTVSS |
| 4-36 | 1232 | EVQLVESGGGLVQPGGSLRLSCAASGRTFSDDTMGWFRQAPGKEREFVAAISWSGGT TRYADSVKGRFTISADNSKNTAYLQMNSLKPEDTAVYYCATDPPLFWGQGTLVTVSS |

TABLE 33-continued

ACE2 Variant Sequences Variable Heavy Chain

| Name | SEQ ID | Amino Acid Sequence |
| --- | --- | --- |
| 4-67 | 1233 | EVQLVESGGGLVQPGGSLRLSCAASGRTFSDDTMGWFRQAPGKEREFVAAINWSGDSTYYADSVKGRFTISADNSKNTAYLQMNSLKPEDTAVYYCATDPPLFWGQGTLVTVSS |
| 4-16 | 1234 | EVQLVESGGGLVQPGGSLRLSCAASGRTFSDDTMGWFRQAPGKEREFVAAINWSGGTTRYADSVKGRFTISADNSKNTAYLQMNSLKPEDTAVYYCATDPPLFWGQGTLVTVSS |
| 4-11 | 1235 | EVQLVESGGGLVQPGGSLRLSCAASGRTFSDDAMGWFRQAPGKEREFVAAIHWSGSSTRYADSVRGRFTISADNSKNTAYLQMNSLKPEDTAVYYCATDPPLFWGQGTLVTVSS |
| 4-68 | 1236 | EVQLVESGGGLVQPGGSLRLSCAASGRTFSDDTMGWFRQAPGKERELVGTINWSGGSTYYADSVKGRFTISADNSKNTAYLQMNSLKPEDTAVYYCATDPPLFWGQGTLVTVSS |
| 4-34 | 1237 | EVQLVESGGGLVQPGGSLRLSCAASGRTFGDYIMGWFRQAPGKEREFVAAINWSGGYTPYADSVKGRFTISADNSKNTAYLQMNSLKPEDTAVYYCATDPPLFWGQGTLVTVSS |
| 4-28 | 1238 | EVQLVESGGGLVQPGGSLRLSCAASGRTFGDDTMGWFRQAPGKERELVAAINWNGGNTHYADSVKGRFTISADNSKNTAYLQMNSLKPEDTAVYYCATDPPLFWGQGTLVTVSS |
| 4-69 | 1239 | EVQLVESGGGLVQPGGSLRLSCAASGRTFSDDAMGWFRQAPGKEREFVAAINWSGGTTRYADSVKGRFTISADNSKNTAYLQMNSLKPEDTAVYYCATDPPLFWGQGTLVTVSS |
| 4-7 | 1240 | EVQLVESGGGLVQPGGSLRLSCAASGRTFGDYIMGWFRQAPGKERESVAAINWSAGYTPYADSVKGRFTISADNSKNTAYLQMNSLKPEDTAVYYCATDPPLFWGHVDLWGQGTLVTVSS |
| 4-71 | 1241 | EVQLVESGGGLVQPGGSLRLSCAASGRTFSDDTMGWFRQAPGKEREWVASINWSGGSTYYADSVKGRFTISADNSKNTAYLQMNSLKPEDTAVYYCATDPPLFWGQGTLVTVSS |
| 4-23 | 1242 | EVQLVESGGGLVQPGGSLRLSCAASGRTFSDDAMGWFRQAPGKEREFVAGISWNGGSIYYADSVKGRFTISADNSKNTAYLQMNSLKPEDTAVYYCATDPPLFWGQGTLVTVSS |
| 4-9 | 1243 | EVQLVESGGGLVQPGGSLRLSCAASGFTFDDYEMGWFRQAPGKEREFVAAISWRGGTTYYADSVKGRFTISADNSKNTAYLQMNSLKPEDTAVYYCAADRRGLASTRAGDYDWGQGTLVTVSS |
| 4-72 | 1244 | EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGHVDLWGQGTLVTVSS |
| 4-73 | 1245 | EVQLVESGGGLVQPGGSLRLSCAASGRTFSDDAMGWFRQAPGKEREFVAAINWSGGSTRYADSVKGRFTISADNSKNTAYLQMNSLKPEDTAVYYCATDPPLFWGQGTLVTVSS |
| 4-29 | 1246 | EVQLVESGGGLVQPGGSLRLSCAASGVTLDDYAMGWFRQAPGKEREFVAVINWSGGSTDYADSVKGRFTISADNSKNTAYLQMNSLKPEDTAVYYCARGGGWVPSSTSESLNWYFDRWGQGTLVTVSS |
| 4-41 | 1247 | EVQLVESGGGLVQPGGSLRLSCAASGRTFGDYIMGWFRQAPGKERESVAAINWSGGTTPYADSVKGRFTISADNSKNTAYLQMNSLKPEDTAVYYCATDPPLFCCHVDLWGQGTLVTVSS |
| 4-74 | 1248 | EVQLVESGGGLVQPGGSLRLSCAASGLTFSDDTMGWFRQAPGKEREFVAAVSWSGGNTYYADSVKGRFTISADNSKNTAYLQMNSLKPEDTAVYYCATDPPLFWGQGTLVTVSS |
| 4-75 | 1249 | EVQLVESGGGLVQPGGSLRLSCAASGRTFGDDTMGWFRQAPGKEREFVAAINWTGGYTPYADSVKGRFTISADNSKNTAYLQMNSLKPEDTAVYYCATDPPLFWGQGTLVTVSS |
| 4-31 | 1250 | EVQLVESGGGLVQPGGSLRLSCAASGRTFGDYIMGWFRQAPGKEREFVATINWTAGYTYYADSVKGRFTISADNSKNTAYLQMNSLKPEDTAVYYCATDPPLFCWHFDHWGQGTLVTVSS |
| 4-32 | 1251 | EVQLVESGGGLVQPGGSLRLSCAASGRTFGDDTMGWFRQAPGKEREFVAAINWSGGNTDYADSVKGRFTISADNSKNTAYLQMNSLKPEDTAVYYCATDPPLFWGQGTLVTVSS |

TABLE 33-continued

ACE2 Variant Sequences Variable Heavy Chain

| Name | SEQ ID | Amino Acid Sequence |
|---|---|---|
| 4-15 | 1252 | EVQLVESGGGLVQPGGSLRLSCAASGRTFGDYTMGWFRQAPGKEREFVAAINWSGGNTYYADSVKGRFTISADNSKNTAYLQMNSLKPEDTAVYYCATDPPLFWGQGTLVTVSS |
| 4-14 | 1253 | EVQLVESGGGLVQPGGSLRLSCAASGRTFSDDTMGWFRQAPGKEREFVAGINWSGNGVYYADSVKGRFTISADNSKNTAYLQMNSLKPEDTAVYYCATDPPLFWGQGTLVTVSS |
| 4-76 | 1254 | EVQLVESGGGLVQPGGSLRLSCAASGRTFGDYAMGWFRQAPGKERELVAPINWSGGSTYYADSVKGRFTISADNSKNTAYLQMNSLKPEDTAVYYCATDPPLFWGQGTLVTVSS |
| 4-50 | 1255 | EVQLVESGGGLVQPGGSLRLSCAASGGTFSNSGMGWFRQAPGKERELVAVVNWSGRRTYYADSVKGRFTISADNSKNTAYLQMNSLKPEDTAVYYCAVPWMDYNRRDWGQGTLVTVSS |
| 4-17 | 1256 | EVQLVESGGGLVQPGGSLRLSCAASGQLANFASYAMGWFRQAPGKEREFVAAITRSGSSTVYADSVKGRFTISADNSKNTAYLQMNSLKPEDTAVYYCATTMNPNPRWGQGTLVTVSS |
| 4-37 | 1257 | EVQLVESGGGLVQPGGSLRLSCAASGRTFSDDIMGWFRQAPGKEREFVAAINWTGGSTYYADSVKGRFTISADNSKNTAYLQMNSLKPEDTAVYYCATDPPLFWGQGTLVTVSS |
| 4-44 | 1258 | EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATARPNTGWHFDHWGQGTLVTVSS |
| 4-77 | 1259 | EVQLVESGGGLVQPGGSLRLSCAASGRTFSDDTMGWFRQAPGKEREWVGSINWSGGSTYYADSVKGRFTISADNSKNTAYLQMNSLKPEDTAVYYCATDPPLFWGQGTLVTVSS |
| 4-78 | 1260 | EVQLVESGGGLVQPGGSLRLSCAASGRTFSDDTMGWFRQAPGKEREFVAGMTWSGSSTFYADSVKGRFTISADNSKNTAYLQMNSLKPEDTAVYYCATDPPLFWGQGTLVTVSS |
| 4-79 | 1261 | EVQLVESGGGLVQPGGSLRLSCAASGRTFGDYIMGWFRQAPGKERECVAAINWSGDYTDYADSVKGRFTISADNSKNTAYLQMNSLKPEDTAVYYCATDPPLFWGQGTLVTVSS |
| 4-8 | 1262 | EVQLVESGGGLVQPGGSLRLSCAASGRTFGDYIMGWFRQAPGKEREFVGGINWSGGYTYYADSVKGRFTISADNSKNTAYLQMNSLKPEDTAVYYCATDPPLFWGQGTLVTVSS |
| 4-81 | 1263 | EVQLVESGGGLVQPGGSLRLSCAASGRTFSDDTMGWFRQAPGKEREFVAAVNWSGGSTYYADSVKGRFTISADNSKNTAYLQMNSLKPEDTAVYYCATDPPLFWGQGTLVTVSS |
| 4-82 | 1264 | EVQLVESGGGLVQPGGSLRLSCAASGRTFGDYAMGWFRQAPGKEREFVAAINWSGGYTRYADSVKGRFTISADNSKNTAYLQMNSLKPEDTAVYYCATDPPLFWGQGTLVTVSS |
| 4-83 | 1265 | EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGQGTLVTVSS |
| 4-35 | 1266 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDRWGQGTLVTVSS |
| 4-45 | 1267 | EVQLVESGGGLVQPGGSLRLSCAASGRTFGDYIMGWFRQAPGKEREFVAAINWSGGYTHYADSVKGRFTISADNSKNTAYLQMNSLKPEDTAVYYCATDPPLFWGQGTLVTVSS |
| 4-84 | 1268 | EVQLVESGGGLVQPGGSLRLSCAASGRTFSDDTMGWFRQAPGKEREFVAAITWSGGRTRYADSVKGRFTISADNSKNTAYLQMNSLKPEDTAVYYCATDRPLFWGQGTLVTVSS |
| 4-85 | 1269 | EVQLVESGGGLVQPGGSLRLSCAASGRTFGDYIMGWFRQAPGKERESVAAINWSGGYTAYADSVKGRFTISADNSKNTAYLQMNSLKPEDTAVYYCATASPNTGWHFDHWGQGTLVTVSS |
| 4-86 | 1270 | EVQLVESGGGLVQPGGSLRLSCAASGRTFSDDTMGWFRQAPGKEREFVAAIHWSGSSTRYADSVKGRFTISADNSKNTAYLQMNSLKPEDTAVYYCATDPPLFWGQGTLVTVSS |

TABLE 33-continued

ACE2 Variant Sequences Variable Heavy Chain

| Name | SEQ ID | Amino Acid Sequence |
| --- | --- | --- |
| 4-87 | 1271 | EVQLVESGGGLVQPGGSLRLSCAASGRTFSDYTMGWFRQAPGKEREWVAAINWSGGTTYYADSVKGRFTISADNSKNTAYLQMNSLKPEDTAVYYCATDPPLFWGQGTLVTVSS |
| 4-88 | 1272 | EVQLVESGGGLVQPGGSLRLSCAASGRTFGDDTMGWFRQAPGKEREFVAAINWSGDNTHYADSVKGRFTISADNSKNTAYLQMNSLKPEDTAVYYCATDPPLFWGQGTLVTVSS |
| 4-89 | 1273 | EVQLVESGGGLVQPGGSLRLSCAASGFAFGDNWIGWFRQAPGKEREWVASISSGGTTAYADNVKGRFTIIADNSKNTAYLQMNSLKPEDTAVYYCAHRGGWLRPWGYWGQGTLVTVSS |
| 4-9 | 1274 | EVQLVESGGGLVQPGGSLRLSCAASGRTFSDDAMGWFRQAPGKEREFVGRINWSGGNTYYADSVKGRFTISADNSKNTAYLQMNSLKPEDTAVYYCATDPPLFWGQGTLVTVSS |
| 4-91 | 1275 | EVQLVESGGGLVQPGGSLRLSCAASGRTFSDDTMGWFRQAPGKEREFVGISWSGGNTYYADSVKGRFTISADNSKNTAYLQMNSLKPEDTAVYYCATDPPLFWGQGTLVTVSS |
| 4-92 | 1276 | EVQLVESGGGLVQPGGSLRLSCAASGRTFSDDTMGWFRQAPGKEREFVAAINWSGGSTYYADSVKGRFTISADNSKNTAYLQMNSLKPEDTAVYYCATDPPLFWGQGTLVTVSS |
| 4-46 | 1277 | EVQLVESGGGLVQPGGSLRLSCAASGRTFGDDTMGWFRQAPGKEREFVAAINWSGGYTYYADSVKGRFTISADNSKNTAYLQMNSLKPEDTAVYYCATDPPLFWGQGTLVTVSS |
| 4-20 | 1278 | EVQLVESGGGLVQPGGSLRLSCAASGRTFGDYIMGWFRQAPGKEREFVAAINWSADYTAYADSVKGRFTISADNSKNTAYLQMNSLKPEDTAVYYCATDPPLFCWHFDHWGQGTLVTVSS |
| 4-93 | 1279 | EVQLVESGGGLVQPGGSLRLSCAASGRTFSDDAMGWFRQAPGKEREFVAAINWSGSSTYYADSVKGRFTISADNSKNTAYLQMNSLKPEDTAVYYCATDPPLFWGQGTLVTVSS |
| 4-4 | 1280 | EVQLVESGGGLVQPGGSLRLSCAASGRTFGDYIMGWFRQAPGKEREMVAAINWIAGYTADADSVRRLFTITADNNKNTAHLMMNLLKPENTAVYYCAEPSPNTGWHFDHWGQGTLVTVSS |
| 4-2 | 1281 | EVQLVESGGGLVQPGGSLRLSCAASGRTFGDDTMGWFRQAPGKEREFVAAINWSGGNTPYADSVKGRFTISADNSKNTAYLQMNSLKPEDTAVYYCATDPPLFWGQGTLVTVSS |
| 4-94 | 1282 | EVQLVESGGGLVQPGGSLRLSCAASGRTFSDDTMGWFRQAPGKEREFVAAINWSGDNTHYADSVKGRFTISADNSKNTAYLQMNSLKPEDTAVYYCATDPPLFWGQGTLVTVSS |
| 4-95 | 1283 | EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATAPPLFCWHFDHWGQGTLVTVSS |
| 4-12 | 1284 | EVQLVESGGGLVQPGGSLRLSCAASGFTFGDYVMGWFRQAPGKEREIVAAINWNAGYTAYADSVRGLFTITADNSKNTAYLQMNSLKPEDTAVYYCAKASPNTGWHFDHWGQGTLVTVSS |
| 4-30 | 1285 | EVQLVESGGGLVQPGGSLRLSCAASGRTFGDYTMGWFRQAPGKEREFVAAINWTGGYTYYADSVKGRFTISADNSKNTAYLQMNSLKPEDTAVYYCATDPPLFWGQGTLVTVSS |
| 4-27 | 1286 | EVQLVESGGGLVQPGGSLRLSCAASGRTFGDYIMGWFRQAPGKEREIVAAINWSAGYTAYADSVKGLFTITADNSKNTAYLQMNILKPEDTAVYYCARATPNTGWHFDHWGQGTLVTVSS |
| 4-22 | 1287 | EVQLVESGGGLVQPGGSLRLSCAASGRTFGDYIMGWFRQAPGKEREFVAAINWSGDNTHYADSVKGRFTISADNSKNTAYLQMNSLKPEDTAVYYCATDPPLFWGQGTLVTVSS |
| 4-96 | 1288 | EVQLVESGGGLVQPGGSLRLSCAASGRTFGDYIMGWFRQAPGKEREIVAAINWSAGYTPYADSVKGRFTISADNSKNTAYLQMNSLKPEDTAVYYCATDPPLFCCHFDHWGQGTLVTVSS |
| 4-97 | 1289 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCATAPPNTGWHFDHWGQGTLVTVSS |

TABLE 33-continued

ACE2 Variant Sequences Variable Heavy Chain

| Name | SEQ ID | Amino Acid Sequence |
|---|---|---|
| 4-98 | 1290 | EVQLVESGGGLVQPGGSLRLSCAASGFTWGDYTMGWFRQAPGKEREFVAAINWSGG<br>NTYYADSVKGRFTISADNSKNTAYLQMNSLKPEDTAVYYCAADRRGLASTRAADYD<br>WGQGTLVTVSS |
| 4-99 | 1291 | EVQLVESGGGLVQPGGSLRLSCAASGIPSTLRAMGWFRQAPGKEREFVAAVSSLGPF<br>TRYADSVKGRFTISADNSKNTAYLQMNSLKPEDTAVYYCAAKPGWVARDPSQYNWG<br>QGTLVTVSS |
| 4-100 | 1292 | EVQLVESGGGLVQPGGSLRLSCAASGFSFDDDYVMGWFRQAPGKEREFVAAINWSG<br>GSTYYADSVKGRFTISADNSKNTAYLQMNSLKPEDTAVYYCAADRRGLASTRAADY<br>DWGQGTLVTVSS |
| 4-101 | 1293 | EVQLVESGGGLVQPGGSLRLSCAASGRTFSNAAMGWFRQAPGKEREFVARILWTGA<br>SRSYADSVKGRFTISADNSKNTAYLQMNSLKPEDTAVYYCATTENPNPRWGQGTLVT<br>VSS |
| 4-102 | 1294 | EVQLVESGGGLVQPGGSLRLSCAASGGTFGVYHMGWFRQAPGKEREGVAAINMSGD<br>DSAYADSVKGRFTISADNSKNTAYLQMNSLKPEDTAVYYCAILVGPGQVEFDHWGQ<br>GTLVTVSS |
| 4-103 | 1295 | EVQLVESGGGLVQPGGSLRLSCAASGFTFSSYYMGWFRQAPGKEREFVARI--<br>SGSTFYADSVKGRFTISADNSKNTAYLQMNSLKPEDTAVYYCAALPFVCPSGSYSDY<br>GDEYDWGQGTLVTVSS |
| 4-104 | 1296 | EVQLVESGGGLVQPGGSLRLSCAASGRTFSGDFMGWFRQAPGKEREFVGRINWSGG<br>NTYYADSVRGLFTITADNNKNTAYLMMNLLKPEDTAVYYCPTDPPLFWGLGTLVTW<br>SS |
| 4-105 | 1297 | EVQLVESGGGLVQPGGSLRLSCAASGSTLRDYAMGWFRQAPGKERESVAAITWSGG<br>STAYADSVKGRFTISADNSKNTAYLQMNSLKPEDTAVYYCASLLAGDRYFDYWGQG<br>TLVTVSS |
| 4-106 | 1298 | EVQLVESGGGLVQPGGSLRLSCAASGFTFDDYTMGWFRQAPGKEREFVAAITDNGGS<br>KYYADSVKGRFTISADNSKNTAYLQMNSLKPEDTAVYYCAADRRGLASTRAADYD<br>WGQGTLVTVSS |
| 4-107 | 1299 | EVQLVESGGGLVQPGGSLRLSCAASGGTFSSYGMGWFRQAPGKEREFVAAINWSGA<br>STYYADSVKGRFTISADNSKNTAYLQMNSLKPEDTAVYYCARDWRDRTWGNSLDY<br>WGQGTLVTVSS |
| 4-108 | 1300 | EVQLVESGGGLVQPGGSLRLSCAASGFSFDDDYVMGWFRQAPGKEREFVAAISWSE<br>DNTYYADSVKGRFTISADNSKNTAYLQMNSLKPEDTAVYYCAADRRGLASTRAADY<br>DWGQGTLVTVSS |
| 4-109 | 1301 | EVQLVESGGGLVQPGGSLRLSCAASGFSFDDDYVMGWFRQAPGKEREFVAAVSGSG<br>DDTYYADSVKGRFTISADNSKNTAYLQMNSLKPEDTAVYYCAADRRGLASTRAADY<br>DWGQGTLVTVSS |
| 4-110 | 1302 | EVQLVESGGGLVQPGGSLRLSCAASGNIAAINVMGWFRQAPGKEREFVAAISASGRR<br>TDYADSVKGRFTISADNSKNTAYLQMNSLKPEDTAVYYCARRVYYYDSSGPPGVTF<br>DIWGQGTLVTVSS |
| 4-111 | 1303 | EVQLVESGGGLVQPGGSLRLSCAASGIITSRYVMGWFRQAPGKEREGVAAISTGGSTI<br>YADSVKGRFTISADNSKNTAYLQMNSLKPEDTAVYYCARQDSSSPYFDYWGQGTLV<br>TVSS |
| 4-112 | 1304 | EVQLVESGGGLVQPGGSLRLSCAASGFSFDDDYVMGWFRQAPGKEREFVAAISNSGL<br>STYYADSVKGRFTISADNSKNTAYLQMNSLKPEDTAVYYCAADRRGLASTRAADYD<br>WGQGTLVTVSS |
| 4-113 | 1305 | EVQLVESGGGLVQPGGSLRLSCAASGSISSINVMGWFRQAPGKEREFVATMRWSTGS<br>TYYADSVKGRFTISADNSKNTAYLQMNSLKPEDTAVYYCAQRVRGFFGPLRTTPSWY<br>EWGQGTLVTVSS |
| 4-114 | 1306 | EVQLVESGGGLVQPGGSLRLSCAASGLTFILYRMGWFRQAPGKEREFVAAINNFGTT<br>KYADSVKGRFTISADNSKNTAYLQMNSLKPEDTAVYYCARTHYDFWSGYTSRTPNY<br>FDYWGQGTLVTVSS |
| 4-115 | 1307 | EVQLVESGGGLVQPGGSLRLSCAASGGTFSVYHMGWFRQAPGKEREPVAAISWSGG<br>STAYADSVKGRFTISADNSKNTAYLQMNSLKPEDTAVYYCAAVNTWTSPSFDSWGQ<br>GTLVTVSS |
| 4-116 | 1308 | EVQLVESGGGLVQPGGSLRLSCAASGRAFSTYGMGWFRQAPGKEREFVAGINWSGD<br>TPYYADSVKGRFTISADNSKNTAYLQMNSLKPEDTAVYYCAREVGPPPGYFDLWGQ<br>GTLVTVSS |

TABLE 33-continued

ACE2 Variant Sequences Variable Heavy Chain

| Name | SEQ ID | Amino Acid Sequence |
|---|---|---|
| 4-117 | 1309 | EVQLVESGGGLVQPGGSLRLSCAASGRTFSDIAMGWFRQAPGKEREFVASINWGGGN<br>TYYADSVKGRFTISADNSKNTAYLQMNSLKPEDTAVYYCAAKGIWDYLGRRDFGD<br>WGQGTLVTVSS |
| 4-118 | 1310 | EVQLVESGGGLVQPGGSLRLSCAASGRTFSSARMGWFRQAPGKEREFVAAISWSGDN<br>THYADSVKGRFTISADNSKNTAYLQMNSLKPEDTAVYYCATTENPNPRWGQGTLVT<br>VSS |
| 4-119 | 1311 | EVQLVESGGGLVQPGGSLRLSCAASGFAFSSYAMGWFRQAPGKEREWVATINGDDY<br>TYYADSVKGRFTISADNSKNTAYLQMNSLKPEDTAVYYCVATPGGYGLWGQGTLVT<br>VSS |
| 4-120 | 1312 | EVQLVESGGGLVQPGGSLRLSCAASGITFRRHDMGWFRQAPGKEREFVAAIRWSSSS<br>TVYADSVKGRFTISADNSKNTAYLQMNSLKPEDTAVYYCAADRGVYGGRWYRTSQ<br>YTWGQGTL VTVSS |
| 4-121 | 1313 | EVQLVESGGGLVQPGGSLRLSCAASGTAASFNPMGWFRQAPGKEREFVAAITSGGST<br>NYADSVKGRFTISADNSKNTAYLQMNSLKPEDTAVYYCAAIAYEEGVYRWDWGQG<br>TLVTVSS |
| 4-122 | 1314 | EVQLVESGGGLVQPGGSLRLSCAASGNINIINYMGWFRQAPGKEREGVAAIHWNGDS<br>TAYADSVKGRFTISADNSKNTAYLQMNSLKPEDTAVYYCASGPPYSNYFAYWGQGT<br>LVTVSS |
| 4-123 | 1315 | EVQLVESGGGLVQPGGSLRLSCAASGFTFDDYAMGWFRQAPGKERESVAAISGSGGS<br>TAYADSVKGRFTISADNSKNTAYLQMNSLKPEDTAVYYCAKIMGSGRPYFDHWGQG<br>TLVTVSS |
| 4-124 | 1316 | EVQLVESGGGLVQPGGSLRLSCAASGNIFTRNVMGWFRQAPGKEREFVAAITSSGST<br>NYADSVKGRFTISADNSKNTAYLQMNSLKPEDTAVYYCARPSSDLQGGVDYWGQGT<br>LVTVSS |
| 4-125 | 1317 | EVQLVESGGGLVQPGGSLRLSCAASGRTFSSIAMGWFRQAPGKEREFVASINWGGGN<br>TIYADSVKGRFTISADNSKNTAYLQMNSLKPEDTAVYYCAAKGIWDYLGRRDFGDW<br>GQGTLVTVSS |
| 4-126 | 1318 | EVQLVESGGGLVQPGGSLRLSCAASGIPSTLRAMGWFRQAPGKEREFVAAVSSLGPFT<br>RYADSVKGRFTISADNSKNTAYLQMNSLKPEDTAVYYCAAKPGWVARDPSEYNWG<br>QGTLVTVSS |
| 4-127 | 1319 | EVQLVESGGGLVQPGGSLRLSCAASGFTLDDSAMGWFRQAPGKEREWVAAITNGGS<br>TYYADSVKGRFTISADNSKNTAYLQMNSLKPEDTAVYYCARFARGSPYFDFWGQGT<br>LVTVSS |
| 4-128 | 1320 | EVQLVESGGGLVQPGGSLRLSCAASGSISSFNAMGWFRQAPGKERESVAAIDWDGST<br>AYADSVKGRFTISADNSKNTAYLQMNSLKPEDTAVYYCARGGGYYGSGSFEYWGQ<br>GTLVTVSS |
| 4-129 | 1321 | EVQLVESGGGLVQPGGSLRLSCAASGNIFSDNIIGWFRQAPGKEREMVAYYTSGGSID<br>YADSVKGRFTISADNSKNTAYLQMNSLKPEDTAVYYCARGTAVGRPPPGGMDVWG<br>QGTLVTVSS |
| 4-130 | 1322 | EVQLVESGGGLVQPGGSLRLSCAASGSISSIGAMGWFRQAPGKEREGVAAISSSGSST<br>VYADSVKGRFTISADNSKNTAYLQMNSLKPEDTAVYYCARVPPGQAYFDSWGQGTL<br>VTVSS |
| 4-131 | 1323 | EVQLVESGGGLVQPGGSLRLSCAASGFTFDDYGMGWFRQAPGKERELVATITWSGD<br>STYYADSVKGRFTISADNSKNTAYLQMNSLKPEDTAVYYCAKGGSWYYDSSGYYGR<br>WGQGTLVTVSS |
| 4-132 | 1324 | EVQLVESGGGLVQPGGSLRLSCAASGRTFSNYTMGWFRQAPGKEREWVSAISWSTGS<br>TYYADSVKGRFTISADNSKNTAYLQMNSLKPEDTAVYYCAADRYGPPWYDWGQGT<br>LVTVSS |
| 4-133 | 1325 | EVQLVESGGGLVQPGGSLRLSCAASGSTNYMGWFRQAPGKEREGVAAISMSGDDTIY<br>ADSVKGRFTISADNSKNTAYLQMNSLKPEDTAVYYCARIGLRGRYFDLWGQGTLVT<br>VSS |
| 4-134 | 1326 | EVQLVESGGGLVQPGGSLRLSCAASGGTFSSVGMGWFRQAPGKERELVAVINWSGA<br>RTYYADSVKGRFTISADNSKNTAYLQMNSLKPEDTAVYYCAVPWMDYNRRDWGQG<br>TLVTVSS |

TABLE 33-continued

ACE2 Variant Sequences Variable Heavy Chain

| Name | SEQ ID | Amino Acid Sequence |
|---|---|---|
| 4-135 | 1327 | EVQLVESGGGLVQPGGSLRLSCAASGRIFTNTAMGWFRQAPGKEREGVAAINWSGGS<br>TAYADSVKGRFTISADNSKNTAYLQMNSLKPEDTAVYYCARTSGSYSFDYWGQGTL<br>VTVSS |
| 4-136 | 1328 | EVQLVESGGGLVQPGGSLRLSCAASGEEFSDHWMGWFRQAPGKEREFVGAIHWSGG<br>RTYYADSVKGRFTISADNSKNTAYLQMNSLKPEDTAVYYCAADRRGLASTRAADYD<br>WGQGTLVTVSS |
| 4-137 | 1329 | EVQLVESGGGLVQPGGSLRLSCAASGRTFSSIAMGWFRQAPGKEREFVAAINWSGAR<br>TAYADSVKGRFTISADNSKNTAYLQMNSLKPEDTAVYYCAAKGIWDYLGRRDFGD<br>WGQGTLVTVSS |
| 4-138 | 1330 | EVQLVESGGGLVQPGGSLRLSCAASGSTSSLRTMGWFRQAPGKEREGVAAISSRDGS<br>TIYADSVKGRFTISADNSKNTAYLQMNSLKPEDTAVYYCARDDSSSPYFDYWGQGTL<br>VTVSS |
| 4-139 | 1331 | EVQLVESGGGLVQPGGSLRLSCAASGGGTFGSYAMGWFRQAPGKEREFVAAISIASG<br>ASGGTTNYADSVKGRFTISADNSKNTAYLQMNSLKPEDTAVYYCATTMNPNPRWGQ<br>GTLVTVSS |
| 4-140 | 1332 | EVQLVESGGGLVQPGGSLRLSCAASGRTFSNAAMGWFRQAPGKEREFVARITWNGG<br>STFYADSVKGRFTISADNSKNTAYLQMNSLKPEDTAVYYCATTENPNPRWGQGTLVT<br>VSS |
| 4-141 | 1333 | EVQLVESGGGLVQPGGSLRLSCAASGIILSDNAMGWFRQAPGKEREFVAAISWLGES<br>TYYADSVKGRFTISADNSKNTAYLQMNSLKPEDTAVYYCAADRRGLASTRAADYDW<br>GQGTLVTVSS |
| 4-142 | 1334 | EVQLVESGGGLVQPGGSLRLSCAASGRTFGDYIMGWFRQAPGKERESVAAINWNGG<br>YTAYADSVKGRFTISADNSKNTAYLQMNSLKPEDTAVYYCATTSPNTGWHYYRWG<br>QGTLVTVSS |
| 4-143 | 1335 | EVQLVESGGGLVQPGGSLRLSCAASGFNFNWYPMGWFRQAPGKERESVAAISWTGV<br>STYTAYADSVKGRFTISADNSKNTAYLQMNSLKPEDTAVYYCARWGPGPAGGSPGL<br>VGFDYWGQGTLVTVSS |
| 4-144 | 1336 | EVQLVESGGGLVQPGGSLRLSCAASGSIRSVSVMGWFRQAPGKEREAVAAISWSGVG<br>TAYADSVKGRFTISADNSKNTAYLQMNSLKPEDTAVYYCAAYQRGWGDWGQGTLV<br>TVSS |
| 4-145 | 1337 | EVQLVESGGGLVQPGGSLRLSCAASGMTFRLYAMGWFRQAPGKEREFVGAINWLSE<br>STYYADSVKGRFTISADNSKNTAYLQMNSLKPEDTAVYYCAAKPGWVARDPSEYNW<br>GQGTLVTVSS |
| 4-146 | 1338 | EVQLVESGGGLVQPGGSLRLSCAASGRTFSDDAMGWFRQAPGKEREFVAAINWSGG<br>STYYADSVKGRFTISADNSKNTAYLQMNSLKPEDTAVYYCATDPPLFWGQGTMVTV<br>SS |
| 4-147 | 1339 | EVQLVESGGGLVQPGGSLRLSCAASGGTFSVYAMGWFRQAPGKEREGVAAISMSGD<br>DAAYADSVKGRFTISADNSKNTAYLQMNSLKPEDTAVYYCAKISKDDGGKPRGAFF<br>DSWGQGTLVTVSS |
| 4-148 | 1340 | EVQLVESGGGLVQPGGSLRLSCAASGFALGYYAMGWFRQAPGKERESVAAISSRDGS<br>TAYADSVKGRFTISADNSKNTAYLQMNSLKPEDTAVYYCARLATGPQAYFHHWGQG<br>TLVTVSS |
| 4-149 | 1341 | EVQLVESGGGLVQPGGSLRLSCAASGFNLDDYAMGWFRQAPGKERESVAAISWDGG<br>ATAYADSVKGRFTISADNSKNTAYLQMNSLKPEDTAVYYCARVGRGTTAFDSWGQG<br>TLVTVSS |
| 4-150 | 1342 | EVQLVESGGGLVQPGGSLRLSCAASGNTFSGGFMGWFRQAPGKEREFVASIRSGART<br>YYADSVKGRFTISADNSKNTAYLQMNSLKPEDTAVYYCAQRVRGFFGPLRTTPSWYE<br>WGQGTLVTVSS |
| 4-151 | 1343 | EVQLVESGGGLVQPGGSLRLSCAASGSIRSINIMGWFRQAPGKEREAVAAISWSGGST<br>VYADSVKGRFTISADNSKNTAYLQMNSLKPEDTAVYYCASLLAGDRYFDYWGQGTL<br>VTVSS |

TABLE 34

| | SARS-CoV-2 S1 Variable Heavy Chain CDRs | | | | | |
|---|---|---|---|---|---|---|
| Name | SEQ ID NO | CDRH1 | SEQ ID NO | CDRH2 | SEQ ID NO | CDRH3 |
| 5-1 | 1344 | GTFSSIGMG | 1524 | AAISWDGGATAYA | 1704 | CAKEDVGKPFDW |
| 5-2 | 1345 | LRFDDYAMG | 1525 | AIKFSGGTTDYA | 1705 | CASWDGLIGLDAYEYDW |
| 5-3 | 1346 | SIFSIDVMG | 1526 | AGISWSGDSTLYA | 1706 | CAAFDGYTGSDW |
| 5-4 | 1347 | FTLADYAMG | 1527 | AVITCSGGSTDYA | 1707 | CAADDCYIGCGW |
| 5-5 | 1348 | RTFSSIAMG | 1528 | AEITEGGISPSGDNIYYA | 1708 | CAAELHSSDYTSPGAESDYGW |
| 5-6 | 1349 | PTFSSYAMMG | 1529 | AAINNFGTTKYA | 1709 | CAASASDYGLGLELFHDEYNW |
| 5-7 | 1350 | STGYMG | 1530 | AAIHSGGSTNYA | 1710 | CATVATALIW |
| 5-8 | 1351 | RPFSEYTMG | 1531 | SSIHWGGRGTNYA | 1711 | CAAELHSSDYTSPGAYAW |
| 5-9 | 1352 | LTLSTYGMG | 1532 | AHIPRSTYSPYYA | 1712 | CAAIGDGAVW |
| 5-10 | 1353 | FTFNNHNMG | 1533 | AAISSYSHTAYA | 1713 | CALQPFGASNYRW |
| 5-11 | 1354 | GIYRVMG | 1534 | ASISSGGGINYA | 1714 | CAAESWGRQW |
| 5-12 | 1355 | YTDSNLWMG | 1535 | AINRSTGSTSYA | 1715 | CATSGSGSPNW |
| 5-13 | 1356 | FTFDYYTMG | 1536 | AAIRSSGGLFYA | 1716 | CAAYLDGYSGSW |
| 5-14 | 1357 | GIFSINVMG | 1537 | SAIRWNGGNTAYA | 1717 | CAGFDGYTGSDW |
| 5-15 | 1358 | FTFDGAAMG | 1538 | ATIRWTNSTDYA | 1718 | CARGRYGIVERW |
| 5-16 | 1359 | RTHSIYPMG | 1539 | AAIHSGGATVYA | 1719 | CAARRWIPPGPIW |
| 5-17 | 1360 | PTFSIYAMG | 1540 | AGIRWSDVYTQYA | 1720 | CALDIDYRDW |
| 5-18 | 1361 | LTFDDNIHVMG | 1541 | AAIHWSGGSTIYA | 1721 | CAADVYPQDYGLGYVEGKMYYGMDW |
| 5-19 | 1362 | LTLDYYAMG | 1542 | ASINWSGGSTYYA | 1722 | CAAYGSGEFDW |
| 5-20 | 1363 | RTIVPYTMG | 1543 | AAISPSAFTEYA | 1723 | CAARRWGYDW |
| 5-21 | 1364 | GTFTTYHMG | 1544 | AHISTGGATNYA | 1724 | CATFPAIVTDSDYDLGNDW |
| 5-22 | 1365 | FTFNVFAMG | 1545 | AAINWSDSRTDYA | 1725 | CASGSDNRARELSRYEYVW |
| 5-23 | 1366 | SIFSIDVMG | 1546 | AAISWSGESTLYA | 1726 | CAAFDGYSGSDW |
| 5-24 | 1367 | FTFSSYSMG | 1547 | AAISSYSHTAYA | 1727 | CALQPFGASSYRW |
| 5-25 | 1368 | NTFSINVMG | 1548 | AAIHWSGDSTLYA | 1728 | CAAFDGYSGNHW |
| 5-26 | 1369 | RTISSYIMG | 1549 | ARIYTGGDTIYA | 1729 | CAARTSYNGRYDYIDDYSW |
| 5-27 | 1370 | RANSINWMG | 1550 | ATITPGGNTNYA | 1730 | CAAAAGSTWYGTLYEYDW |
| 5-28 | 1371 | GTFSVFAMG | 1551 | AEITAGGSTYYA | 1731 | CAVDGPFGW |
| 5-29 | 1372 | FTFDDYPMG | 1552 | ASVLRGGYTWYA | 1732 | CAKDWATGLAW |
| 5-30 | 1373 | FALGYYAMG | 1553 | AGIRWTDAYTEYA | 1733 | CAADVSPSYGSRWYW |
| 5-31 | 1374 | RTLDIHVMG | 1554 | AVINWTGESTLYA | 1734 | CAAFDGYTGNYW |
| 5-32 | 1375 | FTPDNYAMG | 1555 | AALGWSGVTTYHYYA | 1735 | CASDESDAANW |
| 5-33 | 1376 | FTFDDYAMG | 1556 | ATIMWSGNTTYYA | 1736 | CATNDDDV |
| 5-34 | 1377 | RTFSRYIMG | 1557 | AAISWSGGDNTYYA | 1737 | CAAYRIVGGTSPGDWRW |
| 5-35 | 1378 | PTFSIYAMG | 1558 | AGISWNGGSTNYA | 1738 | CALRRRFGGQEW |

TABLE 34-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 5-36 | 1379 | RTFSLNAMG | 1559 | AAISCGGGSTYA | 1739 | CAADNDMGYCSW |
| 5-37 | 1380 | STFSINAMG | 1560 | GGISRSGATTNYA | 1740 | CAADGVPEYSDYASGPVW |
| 5-38 | 1381 | RTFSMHAMG | 1561 | ASISSQGRTNYA | 1741 | CAAEVRNGSDYLPIDW |
| 5-39 | 1382 | VTLDLYAMG | 1562 | AGIRWTDAYTEYA | 1742 | CAVDIDYRDW |
| 5-40 | 1383 | LPFTINVMG | 1563 | AAIHWSGLTTFYA | 1743 | CAELDGYFFAHW |
| 5-41 | 1384 | RAFSNYAMG | 1564 | AWINNRGTTDYADSGSTYYA | 1744 | CASTDDYGVDW |
| 5-42 | 1385 | FTPDDYAMG | 1565 | ASIGYSGRSNSYNYYA | 1745 | CAIAHGSSTYNW |
| 5-43 | 1386 | FTLNYYGMG | 1566 | AAITSGGAPHYA | 1746 | CASAYDRGIGYDW |
| 5-44 | 1387 | LPFSTKSMG | 1567 | AAIHWSGLTSYA | 1747 | CAADRAADFFAQRDEYDW |
| 5-45 | 1388 | RTFSINAMG | 1568 | AAISWSGESTQYA | 1748 | CAAFDGGSGTQW |
| 5-46 | 1389 | EEFSDHWMG | 1569 | AAIHWSGDSTHRNYA | 1749 | CATVGITLNW |
| 5-47 | 1390 | FTFGSYDMG | 1570 | TAINWSGARTAYA | 1750 | CAARSVYSYEYNW |
| 5-48 | 1391 | LPLDLYAMG | 1571 | AGIRWSDAYTEYA | 1751 | CALDIDYRHW |
| 5-49 | 1392 | RTSTVNGMG | 1572 | ASISQSGAATAYA | 1752 | CAADRTYSYSSTGYYW |
| 5-50 | 1393 | FSLDYYGMG | 1573 | AAITSGGTPHYA | 1753 | CASAYNPGIGYDW |
| 5-51 | 1394 | RPNSINWMG | 1574 | ATITPGGNTNYA | 1754 | CAAAAGTTWYGTLYEYDW |
| 5-52 | 1395 | EKFSDHWMG | 1575 | ATITFSGARTAYA | 1755 | CAALIKPSSTDRIFEEW |
| 5-53 | 1396 | LTVVPYAMG | 1576 | AAIRRSAVTNYA | 1756 | CAARRWGYHYW |
| 5-54 | 1397 | TTFNFNVMG | 1577 | AVISWTGESTLYA | 1757 | CAAFDGYTGRDW |
| 5-55 | 1398 | IDVNRNAMG | 1578 | AAITWSGGWRYYA | 1758 | CATTFGDAGIPDQYDFGW |
| 5-56 | 1399 | RTFSSNMG | 1579 | ARIFGGDRTLYA | 1759 | CADINGDW |
| 5-57 | 1400 | GTFSMGWIR | 1580 | GCIGWITYYA | 1760 | CAPFGW |
| 5-58 | 1401 | CTLDYYAMG | 1581 | AGIRWTDAYTEYA | 1761 | CAADVSPSYGGRWYW |
| 5-59 | 1402 | LTFSLYRMC | 1582 | SCISNIDGSTYYA | 1762 | CAADLLGDSDYEPSSGFGW |
| 5-60 | 1403 | RSFSSHRMG | 1583 | AAIMWSGSHRNYA | 1763 | CAAIAYEEGVYRWDW |
| 5-61 | 1404 | RIIVPNTMG | 1584 | TGISPSAFTEYA | 1764 | CAAHGWGCHW |
| 5-62 | 1405 | SIFIISMG | 1585 | TGINWSGGSTTYA | 1765 | CAASAIGSGALRRFEYDW |
| 5-63 | 1406 | FSLDYYDMG | 1586 | AALGWSGGSTDYA | 1766 | CAAGNGGRYGIVERW |
| 5-64 | 1407 | TSISNRVMG | 1587 | ARIYTGGDTLYA | 1767 | CAARKIYRSLSYYGDYDW |
| 5-65 | 1408 | NIDRLYAMG | 1588 | AAIDSDGSTDYA | 1768 | CAALIDYGLGFPIEW |
| 5-66 | 1409 | NTFTINVMG | 1589 | AAINWNGGTTLYA | 1769 | CAAFDGYSGIDW |
| 5-67 | 1410 | FNVNDYAMG | 1590 | AGITSSVGVTNYA | 1770 | CAADIFFVNW |
| 5-68 | 1411 | FTFDHYTMG | 1591 | AAISGSENVTSYA | 1771 | CAAEPYIPVRTMRHMTFLTW |
| 6-1 | 1412 | RTFGNYNMG | 1592 | ATINSLGGTSYA | 1772 | CARVDYYMDVW |
| 6-2 | 1413 | FTMSSSWMG | 1593 | TVISGVGTSYA | 1773 | CARGPDSSGYGFDYW |

TABLE 34-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 6-3 | 1414 | FTFSPSWMG | 1594 | ATINEYGGRNYA | 1774 | CARVDRDFDYW |
| 6-4 | 1415 | FTRDYYTMG | 1595 | AAISRSGSLTSYA | 1775 | CANLAYYDSSGYYDYW |
| 6-5 | 1416 | RTFTMG | 1596 | ASTNSAGSTNYA | 1776 | CTTVDQYFDYW |
| 6-6 | 1417 | TTLDYYAMG | 1597 | AAISWSGGSTAYA | 1777 | CAREDYYDSSGYSW |
| 6-7 | 1418 | FTFSSYWMG | 1598 | ATINWSGVTAYA | 1778 | CARADDYFDYW |
| 6-8 | 1419 | FTLSGIWMG | 1599 | AIITTGGRTTYA | 1779 | CAGYSTFGSSSAYYYYSMDVG |
| 6-9 | 1420 | FTFDYYAMG | 1600 | SAIDSEGRTSYA | 1780 | CARWGPFDIW |
| 6-10 | 1421 | SIASIHAMG | 1601 | AAISRSGGFGSYA | 1781 | CARDDKYYDSSGYPAYFQHW |
| 6-11 | 1422 | LAFNAYAMG | 1602 | ATIGWSGANTYYA | 1782 | CASDPPGW |
| 6-12 | 1423 | STYTTYSMG | 1603 | AAISGSENVTSYA | 1783 | CARVDDYMDVW |
| 6-13 | 1424 | LTFNDYAMG | 1604 | AHIPRSTYSPYYA | 1784 | CAFLVGPQGVDHGAFDVW |
| 6-14 | 1425 | ITFRFKAMG | 1605 | AAVSWDGRNTYYA | 1785 | CASDYYYMDVW |
| 6-15 | 1426 | STVLINAMG | 1606 | AAVRWSDDYTYYA | 1786 | CAKEGRAGSLDYW |
| 6-16 | 1427 | FTFDDAAMG | 1607 | AHISWSGGSTYYA | 1787 | CATFGATVTATNDAFDIW |
| 6-17 | 1428 | NTGSTGYMG | 1608 | AGVINDGSTVYA | 1788 | CARLATSHQDGTGYLFDYW |
| 6-18 | 1429 | LTFRNYAMG | 1609 | AGMMWSGGTTTYA | 1789 | CAREGYYYDSSGYLNYFDYW |
| 6-19 | 1430 | SILSIAVMG | 1610 | AAISPSAVTTYYA | 1790 | CAIGYYDSSGYFDYW |
| 6-20 | 1431 | STLPYHAMG | 1611 | AAITWNGASTSYA | 1791 | CARDRYYDTSASYFESETW |
| 6-21 | 1432 | TLFKINAMG | 1612 | AAITSSGSNIDYTYYA | 1792 | CARSNTGWYSFDYW |
| 6-22 | 1433 | RTFSEVVMG | 1613 | ATIHSSGSTSYA | 1793 | CVRVTSDYSMDSW |
| 6-23 | 1434 | SIFSMNTMG | 1614 | ALINRSGGGINYA | 1794 | CVRLSSGYYDFDYW |
| 6-24 | 1435 | FTLDYYAMG | 1615 | AAINWSGDNTHYA | 1795 | CARAPFYCTTTKCQDNYYYMDVW |
| 6-25 | 1436 | LTFGTYTMG | 1616 | AAISRFGSTYYA | 1796 | CARGGDYDFWSVDYMDVW |
| 6-26 | 1437 | DTFSTSWMG | 1617 | ATINTGGGTNYA | 1797 | CARVTTSFDYW |
| 6-27 | 1438 | ITFRFKAMG | 1618 | ASISRSGTTYYA | 1798 | CATDYSAFDMW |
| 6-28 | 1439 | DTYGSYWMG | 1619 | ATITSDDRTNYA | 1799 | CARVTSSLSGMDVW |
| 6-29 | 1440 | YTLKNYYAMG | 1620 | AAIIWTGESTLDA | 1800 | CAREGYYDSSGYYW |
| 6-30 | 1441 | FAFGDSWMG | 1621 | ATINWSGVTAYA | 1801 | CARADGYFDYW |
| 6-31 | 1442 | DTFSANRMG | 1622 | ASITWSSANTYYA | 1802 | CATFNWNDEGFDFW |
| 6-32 | 1443 | FTLDYYDMG | 1623 | ALISWSGGSTYYA | 1803 | CATDFYGWGTRERDAFDIW |
| 6-33 | 1444 | TFQRINHMG | 1624 | ATINTGGQPNYA | 1804 | CASLIAAQDYYFDYW |
| 6-34 | 1445 | SAFRSNAMG | 1625 | AHISWSSKSTYYA | 1805 | CATYCSSTSCFDYW |
| 6-35 | 1446 | FTLAYYAMG | 1626 | AAISMSGDDTIYA | 1806 | CARELGYSSTVWPW |
| 6-36 | 1447 | FDFSVSWMG | 1627 | TAITWSGDSTNYA | 1807 | CASLLHTGPSGGNYFDYW |

TABLE 34-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 6-37 | 1448 | HTFSTSWMG | 1628 | ATINSLGGTNYA | 1808 | CARVSSGDYGMDVW |
| 6-38 | 1449 | NTFSGGFMG | 1629 | AVISSLSSKSYA | 1809 | CAKVDSGYDYW |
| 6-39 | 1450 | FTFSPSWMG | 1630 | AAISWSGGSTAYA | 1810 | CHGLGEGDPYGDYEGYFDLW |
| 6-40 | 1451 | FTFSDYWMG | 1631 | ARVWWNGGSAYYA | 1811 | CAREVLRQQVVLDYW |
| 6-41 | 1452 | FTFSTSWMG | 1632 | ASINEYGGRNYA | 1812 | CAGLHYYYDSSGYNPTEYYGMDVW |
| 6-42 | 1453 | DTYGSYWMG | 1633 | AVITSGGSTNYA | 1813 | CTHVQNSYYYAMDVW |
| 6-43 | 1454 | RTFSSYAMMG | 1634 | ASVNWDASQINYA | 1814 | CTTLGAVYFDSSGYHDYFDYW |
| 6-44 | 1455 | GTFGVYHMG | 1635 | GRITWTDGSTYYA | 1815 | CFGLLEVYDMTFDYW |
| 6-45 | 1456 | NMFSINAMG | 1636 | TLISWSSGRTSYA | 1816 | CASLGYCSGGSCFDYW |
| 6-46 | 1457 | LTFSAMG | 1637 | ALIRRDGSTIYA | 1817 | CAALGILFGYDAFDIW |
| 6-47 | 1458 | RTFSMHAMG | 1638 | ASITYGGNINYA | 1818 | CAKEGYYDSTGYRTYFQQW |
| 6-48 | 1459 | FTVSNYAMG | 1639 | ASVNWSGGTTSYA | 1819 | CATTGTVTLGYW |
| 6-49 | 1460 | STVLINAMG | 1640 | AAISWSPGRTDYA | 1820 | CARDCSGGSCYSGDYW |
| 6-50 | 1461 | FSFDRWAMG | 1641 | ASLATGGNTNYA | 1821 | CARVTNYDAFDIW |
| 6-51 | 1462 | YTYSSYVMG | 1642 | AAISRFGSTYYA | 1822 | CARDSGEHFWDSGYIDHW |
| 6-52 | 1463 | DTYGSYWMG | 1643 | AAITSGGSTVYA | 1823 | CARVDSRFDYW |
| 6-53 | 1464 | ISINTNVMG | 1644 | AAISTGSVTIYA | 1824 | CARVDDFGYFDLW |
| 6-54 | 1465 | FEFENHWMG | 1645 | AHITAGGLSNYA | 1825 | CGRHWGIYDSSGFSSFDYW |
| 6-55 | 1466 | FTMSSSWMG | 1646 | ARITSGGSTGYA | 1826 | CASVDGYFDYW |
| 6-56 | 1467 | NIFRSNMG | 1647 | AGITWNGDTTYYA | 1827 | CARALGVTYQFDYW |
| 6-57 | 1468 | LTFDDHSMG | 1648 | AAVPLSGNTYYA | 1828 | CASFSGGPADFDYW |
| 6-58 | 1469 | RAVSTYAMG | 1649 | AAISGSENVTSYA | 1829 | CLSVTGDTEDYGVFDTW |
| 6-59 | 1470 | ISGSVFSRTPMG | 1650 | SSIYSDGSNTYYA | 1830 | CAHWSWELGDWFDPW |
| 6-60 | 1471 | DTYGSYWMG | 1651 | ATISQSGAATAYA | 1831 | CAGLLRYSGTYYDAFDVW |
| 6-61 | 1472 | DTYGSYWMG | 1652 | AAINWSGGSTNYA | 1832 | CAGLGWNYMDYW |
| 6-62 | 1473 | STFSGNWMG | 1653 | AVISWTGGSTYYA | 1833 | CATHNSLSGFDYW |
| 6-63 | 1474 | QTFNMG | 1654 | AAIGSGGSTSYA | 1834 | CWRLGNDYFDYW |
| 6-64 | 1475 | IPSIHAMG | 1655 | AAINWSHGVTYYA | 1835 | CGGGYGYHFDYW |
| 6-65 | 1476 | LPFSTLHMG | 1656 | ASLSIFGATGYA | 1836 | CWMYYYDSSGYYGNYYYGMDVW |
| 6-66 | 1477 | LTFSLFAMG | 1657 | AAISSGGSTDYA | 1837 | CARGNTKYYYDSSGYSSAFDYW |
| 6-67 | 1478 | SFSNYAMG | 1658 | AAISSSGALTSYA | 1838 | CWIVGPGPLDGMDVW |
| 6-68 | 1479 | FTLSDRAMG | 1659 | AHITAGGLSNYA | 1839 | CVHLASQTGAGYFDLW |
| 6-69 | 1480 | GTFSSVGMG | 1660 | AGISRSGGTYYA | 1840 | CARYDFWSGYPYW |
| 6-70 | 1481 | FNLDDYADMG | 1661 | AAIGWGGGSTRYA | 1841 | CAREILWFGEFGEPNVW |

TABLE 34-continued

SARS-CoV-2 S1 Variable Heavy Chain CDRs

| Name | SEQ ID NO | CDRH1 | SEQ ID NO | CDRH2 | SEQ ID NO | CDRH3 |
|---|---|---|---|---|---|---|
| 6-71 | 1482 | ITFSNDAMG | 1662 | AIITSSDTNDTTNYA | 1842 | CARLHYYDSSGYFDYW |
| 6-72 | 1483 | STLSINAMG | 1663 | AAIDWSGGSTAYA | 1843 | CARDSSATRTGPDYW |
| 6-73 | 1484 | HTFSGYAMG | 1664 | AVITREGSTYYA | 1844 | CARLGGEGFDYW |
| 6-74 | 1485 | FAFGDSWMG | 1665 | AAITSGGSTDYA | 1845 | CARGLLWFGELFGYW |
| 6-75 | 1486 | GTFSTYWMG | 1666 | AAISRSGGNTYYA | 1846 | CVRHSGTDGDSSFDYW |
| 6-76 | 1487 | LAFDFDGMG | 1667 | AAINSGGSTYYA | 1847 | CARFFRAHDYW |
| 6-77 | 1488 | FTFDRSWMG | 1668 | AAVTEGGTTSYA | 1848 | C'ARADYDFDYW |
| 6-78 | 1489 | RTYDAMG | 1669 | ASVTSGGYTHYA | 1849 | CAKFGRKIVGATELDYW |
| 6-79 | 1490 | SISSIDYMG | 1670 | SWISSSDGSTYYA | 1850 | CARSPSFSQIYYYYYMDVW |
| 6-80 | 1491 | GTFSFYNMG | 1671 | AFISGNGGTSYA | 1851 | CAVVAMRMVTTEGPDVLDVW |
| 6-81 | 1492 | FIGNYHAMG | 1672 | AAVTWSGGTTNYA | 1852 | CAREGYYYDSSGYPYYFDYW |
| 6-82 | 1493 | SSLDAYGMG | 1673 | AAISWGGGSIYYA | 1853 | CARLSQGMVALDYW |
| 6-83 | 1494 | SIASIHAMG | 1674 | AAITWSGAITSYA | 1854 | CAKDGGYGELHYGMEVW |
| 6-84 | 1495 | FTPDDYAMG | 1675 | AAINSGGSYTYYA | 1855 | CARDRGPW |
| 6-85 | 1496 | GTFSVFAMG | 1676 | SAINWSGGSLLYA | 1856 | CALFGDFDYW |
| 6-86 | 1497 | PISGINRMG | 1677 | AVITSNGRPSYA | 1857 | CVRLSSGYFDFDYW |
| 6-87 | 1498 | TSIMVGAMG | 1678 | AIIRGDGRTSYA | 1858 | CARFAGWDAFDIW |
| 6-88 | 1499 | RTFSTHWMG | 1679 | AVINWSGGSIYYA | 1859 | CARLSSDGYNYFDFW |
| 6-89 | 1500 | TIFASAMG | 1680 | AVVNWNGSSTVYA | 1860 | CTTVDQYFNYW |
| 6-90 | 1501 | FPFSIWPMG | 1681 | AAVRWSSTYYA | 1861 | CATGECDGGSCSLAYW |
| 6-91 | 1502 | RTFGNYAMG | 1682 | ASISSSGVSKHYA | 1862 | CVRFGSSWARDLDQW |
| 6-92 | 1503 | FLFDSYASMG | 1683 | ATIWRRGNTYYANYA | 1863 | CTETGTAAW |
| 6-93 | 1504 | LPFSTKSMG | 1684 | AAISMSGLTSYA | 1864 | CLKVLGGDYEADNWFDYW |
| 6-94 | 1505 | NIFRIETMG | 1685 | AGIIRSGGETLYA | 1865 | CARSLYYDRSGSYYFDYW |
| 6-95 | 1506 | IPSSIRAMG | 1686 | AVIRWTGGSTYYA | 1866 | CARDIGYYDSSGYYNDGGFDYW |
| 6-96 | 1507 | FTLSGNWMG | 1687 | AIITSGGRTNYA | 1867 | CAGHATFGGSSSSYYYGMDVW |
| 6-97 | 1508 | FTFSSLAMG | 1688 | AAITWSGDITNYA | 1868 | CLRLSSSGFDHW |
| 6-98 | 1509 | TFGHYAMG | 1689 | AAINWSSRSTVYA | 1869 | CAKSDGLMGELRSASAFDIW |
| 6-99 | 1510 | IPFRSRTMG | 1690 | AGISRSGASTAYA | 1870 | CTHANDYGDYW |
| 6-100 | 1511 | GTFSTSWMG | 1691 | AHITAGGLSNYA | 1871 | CARLLVREDWYFDLW |
| 6-101 | 1512 | GTFSLFAMG | 1692 | AAISWTGDSTYYKYYA | 1872 | CAYNNSSGEYW |
| 6-102 | 1513 | SSFSAYAMG | 1693 | SAIDSEGTTTYA | 1873 | CAGDYNFWSGFDHW |
| 6-103 | 1514 | RTSSPIAMG | 1694 | AVRWSDDYTYYA | 1874 | CAKKLGGYYAFDIW |

TABLE 34-continued

| SARS-CoV-2 S1 Variable Heavy Chain CDRs | | | | | | |
|---|---|---|---|---|---|---|
| Name | SEQ ID NO | CDRH1 | SEQ ID NO | CDRH2 | SEQ ID NO | CDRH3 |
| 6-104 | 1515 | LTFNQYTMG | 1695 | ASITDGGSTYYA | 1875 | CARDSRYMDVW |
| 6-105 | 1516 | PTFSSMG | 1696 | AAISWDGGATAYA | 1876 | CAIEIVVGGIYW |
| 6-106 | 1517 | IPSTLRAMG | 1697 | AATSWSGGSKYYA | 1877 | CATDLYYMDVW |
| 6-107 | 1518 | GVGFSVTNMG | 1698 | AVISSSSSTNYA | 1878 | CTTFNWNDEGFDYW |
| 6-108 | 1519 | GTFGSYGMG | 1699 | AAIRWSGGITYYA | 1879 | CARERYWNPLPYYYYGMDVW |
| 6-109 | 1520 | GTFSTYAMG | 1700 | ASIDWSGLTSYA | 1880 | CARGPFYMYCSGTKCYSTNWFDPW |
| 6-110 | 1521 | PIYAVNRMG | 1701 | AGIWRSGGHRDYA | 1881 | CARGEIDILTGYWYDYW |
| 6-111 | 1522 | FTFSNYWMG | 1702 | GGISRSGVSTSYA | 1882 | CTTLLYYYDSSGYSFDAFDIW |
| 6-112 | 1523 | GTFSAYHMG | 1703 | TIIDNGGPTSYA | 1883 | CTALLYYFDNSGYNFDPFDIW |

TABLE 35

| SARS-CoV-2 S1 Variant Variably Heavy Chain | | |
|---|---|---|
| Name | SEQ ID NO | Amino Acid Sequence |
| 5-1 | 1884 | EVQLVESGGGLVQPGGSLRLSCAASGGTFSSIGMGWFRQAPGKEREFVAAISWDGGATAYADSVKGRFTISADNSKNTAYLQMNSLKPEDTAVYYCAKEDVGKPFDWGQGTLVTVSS |
| 5-2 | 1885 | EVQLVESGGGLVQPGGSLRLSCAASGLRFDDYAMGWFRQAPGKERELVAIKFSGGTTDYADSVKGRFTISADNSKNTAYLQMNSLKPEDTAVYYCASWDGLIGLDAYEYDWGQGTLVTVSS |
| 5-3 | 1886 | EVQLVESGGGLVQPGGSLRLSCAASGSIFSIDVMGWFRQAPGKEREFVAGISWSGDSTLYADSVKGRFTISADNSKNTAYLQMNSLKPEDTAVYYCAAFDGYTGSDWGQGTLVTVSS |
| 5-4 | 1887 | EVQLVESGGGLVQPGGSLRLSCAASGFTLADYAMGWFRQAPGKEREFVAVITCSGGSTDYADSVKGRFTISADNSKNTAYLQMNSLKPEDTAVYYCAADDCYIGCGWGQGTLVTVSS |
| 5-5 | 1888 | EVQLVESGGGLVQPGGSLRLSCAASGRTFSSIAMGWFRQAPGKERELVAEITEGGISPSGDNIYYADSVKGRFTISADNSKNTAYLQMNSLKPEDTAVYYCAAELHSSDYTSPGAESDYGWGQGTLVTVSS |
| 5-6 | 1889 | EVQLVESGGGLVQPGGSLRLSCAASGPTFSSYAMMGWFRQAPGKEREWVAAINNFGTTKYADSVKGRFTISADNSKNTAYLQMNSLKPEDTAVYYCAASASDYGLGLELFHDEYNWGQGTLVTVSS |
| 5-7 | 1890 | EVQLVESGGGLVQPGGSLRLSCAASGSTGYMGWFRQAPGKEREFVAAIHSGGSTNYADSVKGRFTISADNSKNTAYLQMNSLKPEDTAVYYCATVATALIWGQGTLVTVSS |
| 5-8 | 1891 | EVQLVESGGGLVQPGGSLRLSCAASGRPFSEYTMGWFRQAPGKEREFVSSIHWGGRGTNYADSVKGRFTISADNSKNTAYLQMNSLKPEDTAVYYCAAELHSSDYTSPGAYAWGQGTLVTVSS |
| 5-9 | 1892 | EVQLVESGGGLVQPGGSLRLSCAASGLTLSTYGMGWFRQAPGKEREFVAHIPRSTYSPYYADSVKGRFTISADNSKNTAYLQMNSLKPEDTAVYYCAAIGDGAVWGQGTLVTVSS |
| 5-10 | 1893 | EVQLVESGGGLVQPGGSLRLSCAASGFTFNNHNMGWFRQAPGKEREFVAAISSYSHTAYADSVKGRFTISADNSKNTAYLQMNSLKPEDTAVYYCALQPFGASNYRWGQGTLVTVSS |

TABLE 35-continued

SARS-CoV-2 S1 Variant Variably Heavy Chain

| Name | SEQ ID NO | Amino Acid Sequence |
|---|---|---|
| 5-11 | 1894 | EVQLVESGGGLVQPGGSLRLSCAASGGIYRVMGWFRQAPGKERELVASISSGGGI NYADSVKGRFTISADNSKNTAYLQMNSLKPEDTAVYYCAAESWGRQWGQGTLV TVSS |
| 5-12 | 1895 | EVQLVESGGGLVQPGGSLRLSCAASGYTDSNLWMGWFRQAPGKEREFVAINRST GSTSYADSVKGRFTISADNSKNTAYLQMNSLKPEDTAVYYCATSGSGSPNWGQG TLVTVSS |
| 5-13 | 1896 | EVQLVESGGGLVQPGGSLRLSCAASGFTFDYYTMGWFRQAPGKEREFVAAIRSS GGLFYADSVKGRFTISADNSKNTAYLQMNSLKPEDTAVYYCAAYLDGYSGSWG QGTLVTVSS |
| 5-14 | 1897 | EVQLVESGGGLVQPGGSLRLSCAASGGIFSINVMGWFRQAPGKEREWVSAIRWN GGNTAYADSVKGRFTITADNSKNTAYLQMNSLKPEDTAVYYCAGFDGYTGSDW GQGTLVTVSS |
| 5-15 | 1898 | EVQLVESGGGLVQPGGSLRLSCAASGFTFDGAAMGWFRQAPGKEREFVATIRWT NSTDYADSVKGRFTISADNSKNTAYLQMNSLKPEDTAVYYCARGRYGIVERWG QGTLVTVSS |
| 5-16 | 1899 | EVQLVESGGGLVQPGGSLRLSCAASGRTHSIYPMGWFRQAPGKERELVAAIHSG GATVYADSVKGRFTISADNSKNTAYLQMNSLKPEDTAVYYCAARRWIPPGPIWG QGTLVTVSS |
| 5-17 | 1900 | EVQLVESGGGLVQPGGSLRLSCAASGPTFSIYAMGWFRQAPGKEREFVAGIRWS DVYTQYADSVKGRFTISADNSKNTAYLQMNSLKPEDTAVYYCALDIDYRDWGQ GTLVTVSS |
| 5-18 | 1901 | EVQLVESGGGLVQPGGSLRLSCAASGLTFDDNIHVMGWFPQAPGKEREFVAAIH WSGGSTIYADSVKGRFTINADNSKNTAYLQMNSLKPEDTAVYYCAADVYPQDY GLGYVEGKMYYGMDWGQGTLVTVSS |
| 5-19 | 1902 | EVQLVESGGGLVQPGGSLRLSCAASGLTLDYYAMGWFRQAPGKEREWVASINW SGGSTYYADSVKGRFTISADNSKNTAYLQMNSLKPEDTAVYYCAAYGSGEFDW GQGTLVTVSS |
| 5-20 | 1903 | EVQLVESGGGLVQPGGSLRLSCAASGRTIVPYTMGWFRQAPGKERELVAAISPSA FTEYADSVKGRFTISADNSKNTAYLQMNSLKPEDTAVYYCAARRWGYDWGQGT LVTVSS |
| 5-21 | 1904 | EVQLVESGGGLVQPGGSLRLSCAASGGTFTTYHMGWFRQAPGKEREFVAHISTG GATNYADSVKGRFTISADNSKNTAYLQMNSLKPEDTAVYYCATFPAIVTDSDYD LGNDWGQGTLVTVSS |
| 5-22 | 1905 | EVQLVESGGGLVQPGGSLRLSCAASGFTFNVFAMGWFRQAPGKEREFVAAINWS DSRTDYADSVKGRFTISADNSKNTAYLQMNSLKPEDTAVYYCASGSDNRARELS RYEYVWGQGTLVTVSS |
| 5-23 | 1906 | EVQLVESGGGLVQPGGSLRLSCAASGSIFSIDVMGWFRQAPGKEREFVAAISWSG ESTLYADSVKGRFTISADNSKNTAYLQMNSLKPEDTAVYYCAAFDGYSGSDWGQ GTLVTVSS |
| 5-24 | 1907 | EVQLVESGGGLVQPGGSLRLSCAASGFTFSSYSMGWFRQAPGKEREFVAAISSYS HTAYADSVKGRFTIIADNSKNTAYLQMNSLKPEDTAVYYCALQPFGASSYRWGQ GTLVTVSS |
| 5-25 | 1908 | EVQLVESGGGLVQPGGSLRLSCAASGNTFSINVMGWFRQAPGKEREFVAAIHWS GDSTLYADSGKGRFTIIADNNKNTAYLQMISLKPEDTAVYYCAAFDGYSGNHWG QGTLVTVSS |
| 5-26 | 1909 | EVQLVESGGGLVQPGGSLRLSCAASGRTISSYIMGWFRQAPGKERELVARIYTGG DTIYADSVKGRFTISADNSKNTAYLQMNSLKPEDTAVYYCAARTSYNGRYDYID DYSWGQGTLVTVSS |
| 5-27 | 1910 | EVQLVESGGGLVQPGGSLRLSCAASGRANSINWMGWFRQAPGKEREFVATITPG GNTNYADSVKGRFTISADNSKNTAYLQMNSLKPEDTAVYYCAAAAGSTWYGTL YEYDWGQGTLVTVSS |
| 5-28 | 1911 | EVQLVESGGGLVQPGGSLRLSCAASGGTFSVFAMGWFRQVPGKERELVAEITAG GSTYYADSVKGRFTISADNSKNTAYLQMNSLKPEDTAVYYCAVDGPFGWGQGT LVTVSS |
| 5-29 | 1912 | EVQLVESGGGLVQPGGSLRLSCAASGFTFDDYPMGWFRQAPGKEREGVASVLRG GYTWYADSVKGRFTISADNSKNTAYLQMNSLKPEDTAVYYCAKDWATGLAWG QGTLVTVSS |

TABLE 35-continued

SARS-CoV-2 S1 Variant Variably Heavy Chain

| Name | SEQ ID NO | Amino Acid Sequence |
|---|---|---|
| 5-30 | 1913 | EVQLVESGGGLVQPGGSLRLSCAASGFALGYYAMGWFRQAPGKEREFVAGIRW TDAYTEYADSVKGRFTISADNSKNTAYLQMNSLKPEDTAVYYCAADVSPSYGSR WYWGQGTLVTVSS |
| 5-31 | 1914 | EVQLVESGGGLVQPGGSLRLSCAASGRTLDIHVMGWFRQAPGKEREFVAVINWT GESTLYADSVKGRFTISADNSKNTAYLQMNSLKPEDTAVYYCAAFDGYTGNYW GQGTLVTVSS |
| 5-32 | 1915 | EVQLVESGGGLVQPGGSLRLSCAASGFTPDNYAMGWFRQAPGKEREFVAALGW SGVTTYHYYADSVKGRFTISADNSKNTAYLQMNSLKPEDTAVYYCASDESDAAN WGQGTLVTVSS |
| 5-33 | 1916 | EVQLVESGGGLVQPGGSLRLSCAASGFTFDDYAMGWFRQAPGKERELVATIMW SGNTTYYADSVRRRFIIRDNNNKNTAHLQMNSLKPEDTAVYYCATNDDDVWGQ GTLVTVSS |
| 5-34 | 1917 | EVQLVESGGGLVQPGGSLRLSCAASGRTFSRYIMGWFRQAPGKEREFVAAISWSG GDNTYYADSVKGRFTISADNSKNTAYLQMNSLKPEDTAVYYCAAYRIWGGTSP GDWRWGQGTLVTVSS |
| 5-35 | 1918 | EVQLVESGGGLVQPGGSLRLSCAASGPTFSIYAMGWFRQAPGKERELVAGISWN GGSTNYADSVKGRFTISADNSKNTAYLQMNSLKPEDTAVYYCALRRRFGGQEW GQGTLVTVSS |
| 5-36 | 1919 | EVQLVESGGGLVQPGGSLRLSCAASGRTFSLNAMGWFRQAPGKERELVAAISCG GGSTYADNGKGRFTIITDNSKNTAYLQMMNLKPEDTAAYYCAADNDMGYCSW GQGTLVTVSS |
| 5-37 | 1920 | EVQLVESGGGLVQPGGSLRLSCAASGSTFSINAMGWFRQAPGKEREFVGGISRSG ATTNYADSVKGRFTISADNSKNTAYLQMNSLKPEDTAVYYCAADGVPEYSDYAS GPVWGQGTLVTVSS |
| 5-38 | 1921 | EVQLVESGGGLVQPGGSLRLSCAASGRTFSMHAMGWFRQAPGKERELVASISSQ GRTNYADSVKGRFTISADNSKNTAYLQMNSLKPEDTAVYYCAAEVRNGSDYLPI DWGQGTLVTVSS |
| 5-39 | 1922 | EVQLVESGGGLVQPGGSLRLSCAASGVTLDLYAMGWFRQAPGKEREFVAGIRW TDAYTEYADSVKGRFTISADNSKNTAYLQMNSLKPEDTAVYYCAVDIDYRDWG QGTLVTVSS |
| 5-40 | 1923 | EVQLVESGGGLVQPGGSLRLSCAASGLPFTINVMGWFRQAPGKEREFVAAIHWS GLTTFYADSVKGLFTITEDNSKNTAHLMMNLLKPEDTAVYCCAELDGYFFAHWG QGTLVTVSS |
| 5-41 | 1924 | EVQLVESGGGLVQPGGSLRLSCAASGRAFSNYAMGWFRQAPGKEREFVAWINN RGTTDYADSGSTYYADSVKGRFTISADNSKNTAYLQMNSLKPEDTAVYYCASTD DYGVDWGQGTLVTVSS |
| 5-42 | 1925 | EVQLVESGGGLVQPGGSLRLSCAASGFTPDDYAMGWFRQAPGKEREFVASIGYS GRSNSYNYYADSVKGRFTISADNSKNTAYLQMNSLKPEDTAVYYCAIAHGSSTY NWGQGTLVTVSS |
| 5-43 | 1926 | EVQLVESGGGLVQPGGSLRLSCAASGFTLNYYGMGWFPQAPGKEREFVAAITSG GAPHYADSVKGRFTINADNSKNTAYLQMNSLKPEDTAVYYCASAYDRGIGYDW GQGTLVTVSS |
| 5-44 | 1927 | EVQLVESGGGLVQPGGSLRLSCAASGLPFSTKSMGWFRQAPGKEREFVAAIHWS GLTSYADSVKGRFTISADNSKNTAYLQMNSLKPEDTAVYYCAADRAADFFAQRD EYDWGQGTLVTVSS |
| 5-45 | 1928 | EVQLVESGGGLVQPGGSLRLSCAASGRTFSINAMGWFPQAPGKERELVAAISWSG ESTQYADSVKGRFTISADNSKNTAYLQMNSLKPEDTAVYYCAAFDGGSGTQWG QGTLVTVSS |
| 5-46 | 1929 | EVQLVESGGGLVQPGGSLRLSCAASGEEFSDHWMGWFRQAPGKEREFVAAIHW SGDSTHRNYADSVKGRFTISADNSKNTAYLQMNSLKPEDTAVYYCATVGITLNW GQGTLVTVSS |
| 5-47 | 1930 | EVQLVESGGGLVQPGGSLRLSCAASGFTFGSYDMGWFRQAPGKEREFVTAINWS GARTAYADSVKGRFTISADNSKNTAYLQMNSLKPEDTAVYYCAARSVYSYEYN WGQGTLVTVSS |

TABLE 35-continued

SARS-CoV-2 S1 Variant Variably Heavy Chain

| Name | SEQ ID NO | Amino Acid Sequence |
|---|---|---|
| 5-48 | 1931 | EVQLVESGGGLVQPGGSLRLSCAASGLPLDLYAMGWFPPAPGKELEFVAGIRWS DAYTEYADSVKGRFTINADNSKNPANLQMNSLKPEDTAVYYCALDIDYRHWGQ GTLVTVSS |
| 5-49 | 1932 | EVQLVESGGGLVQPGGSLRLSCAASGRTSTVNGMGWFRQAPGKEREFVASISQS GAATAYADSVKGRFTISADNSKNTAYLQMNSLKPEDTAVYYCAADRTYSYSSTG YYWGQGTLVTVSS |
| 5-50 | 1933 | EVQLVESGGGLVQPGGSLRLSCAASGFSLDYYGMGWFRQAPGKEREFVAAITSG GTPHYADSVKGRFTISADNSKNTAYLQMNSLKPEDTAVYYCASAYNPGIGYDWG QGTLVTVSS |
| 5-51 | 1934 | EVQLVESGGGLVQPGGSLRLSCAASGRPNSINWMGWFRQAPGKERQFVATITPG GNTNYADSVKGRFTISADNSKNTAYLLMNSLKPEDTAVYYCAAAGTTWYGTL YEYDWGQGTLVTVSS |
| 5-52 | 1935 | EVQLVESGGGLVQPGGSLRLSCAASGEKFSDHWMGWFRQAPGKEREFVATITFS GARTAYADSVKGRFTISADNSKNTAYLQMNSLKPEDTAVYYCAALIKPSSTDRIF EEWGQGTLVTVSS |
| 5-53 | 1936 | EVQLVESGGGLVQPGGSLRLSCAASGLTVVPYAMGWFRQAPGKEREFVAAIRRS AVTNYADSVKGRFTIIADNSKNTAYLLMNSLKPEDTAVYYCAARRWGYHYWGQ GTLVTVSS |
| 5-54 | 1937 | EVQLVESGGGLVQPGGSLRLSCAASGTTFNFNVMGWFRQAPGKERELVAVISWT GESTLYADSVKGRFTISADNSKNTAYLQMNSLKPEDTAVYYCAAFDGYTGRDW GQGTLVTVSS |
| 5-55 | 1938 | EVQLVESGGGLVQPGGSLRLSCAASGIDVNRNAMGWFRQAPGKEREFVAAITWS GGWRYYADSVKGRFTISADNSKNTAYLQMNSLKPEDTAVYYCATTFGDAGIPDQ YDFGWGQGTLVTVSS |
| 5-56 | 1939 | EVQLVESGGGLVQPGGSLRLSCAASGRTFSSNMGWFRQAPGKEREFVARIFGGD RTLYADSVKGRFTISADNSKNTAYLQMNSLKPEDTAVYYCADINGDWGQGTLVT VSS |
| 5-57 | 1940 | EVQLVESGGGLVQPGGSLRLSCAASGGTFSMGWIRWVPQAQGKELEFMGCIGWI TYYADYAKSRFSLFTDNADNTKNPPNMHMNPQKPEDTAVYYCAPFGWGQGTLV TVSS |
| 5-58 | 1941 | EVQLVESGGGLVQPGGSLRLSCAASGCTLDYYAMGWFRQAPGKEREFVAGIRW TDAYTEYADSVKGRFTISADNSKNTAYLQMNSLKPEDTAVYYCAADVSPSYGGR WYWGQGTLVTVSS |
| 5-59 | 1942 | EVQLVESGGGLVQPGGSLRLSCAASGLTFSLYRMCWFRQAPGKEREEVSCISNID GSTYYADSVKGRFTISADNSKNTAYLQMNSLKPEDTAVYYCAADLLGDSDYEPS SGFGWGQGTLVTVSS |
| 5-60 | 1943 | EVQLVESGGGLVQPGGSLRLSCAASGRSFSSHRMGWFRQAPGKEREFVAAIMWS GSHRNYADSVKGRFTISADNSKNTAYLQMNSLKPEDTAVYYCAAIAYEEGVYR WDWGQGTLVTVSS |
| 5-61 | 1944 | EVQLVESGGGLVQPGGSLRLSCAASGRIIVPNTMGWFRQAPGKERERVTGISPSAF TEYADSVKGRFTISADNSKNTAYLQMNSLKPEDTAVYYCAAHGWGCHWGQGTL VTVSS |
| 5-62 | 1945 | EVQLVESGGGLVQPGGSLRLSCAASGSIFIISMGWFRQAPGKEHEFVTGINWSGGS TTYADSVKGRFTINADNSKNTAYLQMNSLKPEDTAVYYCAASAIGSGALRRFEY DWGQGTLVTVSS |
| 5-63 | 1946 | EVQLVESGGGLVQPGGSLRLSCAASGFSLDYYDMGWFRQAPGKEREFVAALGW SGGSTDYADSVKGRFTISADNSKNTAYLQMNSLKPEDTAVYYCAAGNGGRYGIV ERWGQGTLVTVSS |
| 5-64 | 1947 | EVQLVESGGGLVQPGGSLRLSCAASGTSISNRVMGWFRQAPGKERELVARIYTG GDTLYADSVKGRFTISADNSKNTAYLQMNSLKPEDTAVYYCAARKIYRSLSYYG DYDWGQGTLVTVSS |
| 5-65 | 1948 | EVQLVESGGGLVQPGGSLRLSCAASGNIDRLYAMGWFRQAPGKEREGVAAIDSD GSTDYADSVKGRFTISADNSKNTAYLQMNSLKPEDTAVYYCAALIDYGLGFPIEW GQGTLVTVSS |

TABLE 35-continued

SARS-CoV-2 S1 Variant Variably Heavy Chain

| Name | SEQ ID NO | Amino Acid Sequence |
|---|---|---|
| 5-66 | 1949 | EVQLVESGGGLVQPGGSLRLSCAASGNTFTINVMGWFRQAPGKEREFVAAINWN GGTTLYADSVKGRFTISADNSKNTAYLQMNSLKPEDTAVYYCAAFDGYSGIDWG QGTLVTVSS |
| 5-67 | 1950 | EVQLVESGGGLVQPGGSLRLSCAASGFNVNDYAMGWFRQAPGKEREFVAGITSS VGVTNYADSVKGRFTISADNSKNTAYLQMNSLKPEDTAVYYCAADIFFVNWGR GTLVTVSS |
| 5-68 | 1951 | EVQLVESGGGLVQPGGSLRLSCAASGFTFDHYTMGWFRQAPGKEREFVAAISGS ENVTSYADSVKGRFTISADNSKNTAYLQMNSLKPEDTAVYYCAAEPYIPVRTMR HMTFLTWGQGTLVTVSS |
| 6-1 | 1952 | EVQLVESGGGLVQPGGSLRLSCAASGRTFGNYNMGWFRQAPGKEREFVATINSL GGTSYADSVKGRFTISADNSKNTAYLQMNSLKPEDTAVYYCARVDYYMDVWG QGTLVTVSS |
| 6-2 | 1953 | EVQLVESGGGLVQPGGSLRLSCAASGFTMSSSWMGWFRQAPGKEREFVTVISGV GTSYADSVKGRFTISADNSKNTAYLQMNSLKPEDTAVYYCARGPDSSGYGFDYW GQGTLVTVSS |
| 6-3 | 1954 | EVQLVESGGGLVQPGGSLRLSCAASGFTFSPSWMGWFRQAPGKEREFVATINEY GGRNYADSVKGRFTISADNSKNTAYLQMNSLKPEDTAVYYCARVDRDFDYWGQ GTLVTVSS |
| 6-4 | 1955 | EVQLVESGGGLVQPGGSLRLSCAASGFTRDYYTMGWFRQAPGKEREFVAAISRS GSLTSYADSVKGRFTISADNSKNTAYLQMNSLKPEDTAVYYCANLAYYDSSGYY DYWGQGTLVTVSS |
| 6-5 | 1956 | EVQLVESGGGLVQPGGSLRLSCAASGRTFTMGWFRQAPGKEREFVASTNSAGST NYADSVNGRFTISADNSKNTAYLQMNSLKPEDTAVYYCTTVDQYFDYWGQGTL VTVSS |
| 6-6 | 1957 | EVQLVESGGGLVQPGGSLRLSCAASGTTLDYYAMGWFRQAPGKERELVAAISWS GGSTAYADSVKGRFTISADNSKNTAYLQMNSLKPEDTAVYYCAREDYYDSSGYS WGQGTLVTVSS |
| 6-7 | 1958 | EVQLVESGGGLVQPGGSLRLSCAASGFTFSSYWMGWFRQAPGKEREFVATINWS GVTAYADSVKGRFTISADNSKNTAYLQMNSLKPEDTAVYYCARADDYFDYWGQ GTLVTVSS |
| 6-8 | 1959 | EVQLVESGGGLVQPGGSLRLSCAASGFTLSGIWMGWFLQAPGKEHEFVAIITTGG RTTYADSXKGRFTSSSDNSKNTAYLQMNLLKPEDTAEYYCAGYSTFGSSSAYYY YSMDVGWGQGTLVTVSS |
| 6-9 | 1960 | EVQLVESGGGLVQPGGSLRLSCAASGFTFDYYAMGWFRQAPGKEREFVSAIDSE GRTSYADSVKGRFTISADNSKNTAYLQMNSLKPEDTAVYYCARWGPFDIWGQGT LVTVSS |
| 6-10 | 1961 | EVQLVESGGGLVQPGGSLRLSCAASGSIASIHAMGWFRQAPGKEREFVAAISRSG GFGSYADSVKGRFTISADNSKNTAYLQMNSLKPEDTAVYYCARDDKYYDSSGYP AYFQHWGQGTLVTVSS |
| 6-11 | 1962 | EVQLVESGGGLVQPGGSLRLSCAASGLAFNAYAMGWFRQAPGKEREEVATIGW SGANTYYADSVKGRFTISADNSKNTAYLQMNSLKPEDTAVYYCASDPPGWGQG TLVTVSS |
| 6-12 | 1963 | EVQLVESGGGLVQPGGSLRLSCAASGSTYTTYSMGWFRQAPGKEREFVAAISGSE NVTSYADSVKGRFTISADNSKNTAYLQMNSLKPEDTAVYYCARVDDYMDVWG QGTLVTVSS |
| 6-13 | 1964 | EVQLVESGGGLVQPGGSLRLSCAASGLTFNDYAMGWFRQAPGKEREFVAHIPRS TYSPYYADSVKGRFTISADNSKNTAYLQMNSLKPEDTAVYYCAFLVGPQGVDHG AFDVWGQGTLVTVSS |
| 6-14 | 1965 | EVQLVESGGGLVQPGGSLRLSCAASGITFRFKAMGWFRQAPGKEREFVAVSWD GRNTYYADSVKGRFTISADNSKNTAYLQMNSLKPEDTAVYYCASDYYYMDVW GQGTLVTVSS |
| 6-15 | 1966 | EVQLVESGGGLVQPGGSLRLSCAASGSTVLINAMGWFRQAPGKEREFVAAVRWS DDTYYADSVKGRFTISADNSKNTAYLQMNSLKPEDTAVYYCAKEGRAGSLDY WGQGTLVTVSS |

TABLE 35-continued

SARS-CoV-2 S1 Variant Variably Heavy Chain

| Name | SEQ ID NO | Amino Acid Sequence |
|---|---|---|
| 6-16 | 1967 | EVQLVESGGGLVQPGGSLRLSCAASGFTFDDAAMGWFRQAPGKEREFVAHISWS GGSTYYADSVKGRFTISADNSKNTAYLQMNSLKPEDTAVYYCATFGATVTATND AFDIWGQGTLVTVSS |
| 6-17 | 1968 | EVQLVESGGGLVQPGGSLRLSCAASGNTGSTGYMGWFRQAPGKEREMVAGVIN DGSTYYADSVKGRFTISADNSKNTAYLQMNSLKPEDTAVYYCARLATSHQDTG YLFDYWGQGTLVTVSS |
| 6-18 | 1969 | EVQLVESGGGLVQPGGSLRLSCAASGLTFRNYAMGWFRQAPGKEREFIAGMMW SGGTTTYADSVKGRFTISADNSKNTAYLQMNSLKPEDTAVYYCAREGYYYDSSG YLNYFDYWGQGTLVTVSS |
| 6-19 | 1970 | EVQLVESGGGLVQPGGSLRLSCAASGSILSIAVMGWFRQAPGKEREFVAAISPSA VTTYYADSVKGRFTISADNSKNTAYLQMNSLKPEDTAVYYCAIGYYDSSGYFDY WGQGTLVTVSS |
| 6-20 | 1971 | EVQLVESGGGLVQPGGSLRLSCAASGSTLPYHAMGWFRQAPGKEREFVAAITWN GASTSYADSVKGRFTISADNSKNTAYLQMNSLKPEDTAVYYCARDRYYDTSASY FESETWGQGTLVTVSS |
| 6-21 | 1972 | EVQLVESGGGLVQPGGSLRLSCAASGTLFKINAMGWFRQAPGKEREFVAAITSSG SNIDYTYYADSVKGRFTISADNSKNTAYLQMNSLKPEDTAVYYCARSNTGWYSF DYWGQGTLVTVSS |
| 6-22 | 1973 | EVQLVESGGGLVQPGGSLRLSCAASGRTFSEVVMGWFRQAPGKEREFVATIHSSG STSYADSVKGRFTISADNSKNTAYLQMNSLKPEDTAVYYCVRVTSDYSMDSWG QGTLVTVSS |
| 6-23 | 1974 | EVQLVESGGGLVQPGGSLRLSCAASGSIFSMNTMGWFRQAPGKEREFVALINRSG GGINYADSVKGRFTISADNSKNTAYLQMNSLKPEDTAVYYCVRLSSGYYDFDYW GQGTLVTVSS |
| 6-24 | 1975 | EVQLVESGGGLVQPGGSLRLSCAASGFTLDYYAMGWFRQAPGKEREFVAAINWS GDNTHYADSVKGRFTISADNSKNTAYLQMNSLKPEDTAVYYCARAPFYCTTTKC QDNYYYMDVWGQGTLVTVSS |
| 6-25 | 1976 | EVQLVESGGGLVQPGGSLRLSCAASGLTFGTYTMGWFRQAPGKEREFVAAISRF GSTYYADSVKGRFTISADNSKNTAYLQMNSLKPEDTAVYYCARGGDYDFWSVD YMDVWGQGTLVTVSS |
| 6-26 | 1977 | EVQLVESGGGLVQPGGSLRLSCAASGDTFSTSWMGWFRQAPGKEREFVATINTG GGTNYADSVKGRFTISADNSKNTAYLQMNSLKPEDTAVYYCARVTTSFDYWGQ GTLVTVSS |
| 6-27 | 1978 | EVQLVESGGGLVQPGGSLRLSCAASGITFRFKAMGWFRQAPGKEREFVASISRSG TTYYADSVKGRFTISADNSKNTAYLQMNSLKPEDTAVYYCATDYSAFDMWGQG TLVTVSS |
| 6-28 | 1979 | EVQLVESGGGLVQPGGSLRLSCAASGDTYGSYWMGWFRQAPGKEREFVATITSD DRTNYADSVKGRFTISADNSKNTAYLQMNSLKPEDTAVYYCARVTSSLSGMDV WGQGTLVTVSS |
| 6-29 | 1980 | EVQLVESGGGLVQPGGSLRLSCAASGYTLKNYYAMGWFRQAPGKERXLVAAII WTGESTLDADSVKGRFTISADNSKNTAYLQMNSLKPEDTAVYYCAREGYYDSSG YYWGQGTLVTVSS |
| 6-30 | 1981 | EVQLVESGGGLVQPGGSLRLSCAASGFAFGDSWMGWFRQAPGKEREFVATINWS GVTAYADSVKGRFTISADNSKNTAYLQMNSLKPEDTAVYYCARADGYFDYWGQ GTLVTVSS |
| 6-31 | 1982 | EVQLVESGGGLVQPGGSLRLSCAASGDTFSANRMGWFRQAPGKEREFVASITWS SANTYYADSVKGRFTISADNSKNTAYLQMNSLKPEDTAVYYCATFNWNDEGFDF WGQGTLVTVSS |
| 6-32 | 1983 | EVQLVESGGGLVQPGGSLRLSCAASGFTLDYYDMGWFRQAPGKEREFVALISWS GGSTYYADSVKGRFTISADNSKNTAYLQMNSLKPEDTAVYYCATDFYGWGTRE RDAFDIWGQGTLVTVSS |
| 6-33 | 1984 | EVQLVESGGGLVQPGGSLRLSCAASGTFQRINHMGWFRQAPGKEREFVATINTG GQPNYADSVKGRFTISADNSKNTAYLQMNSLKPEDTAVYYCASLIAAQDYYFDY WGQGTLVTVSS |

TABLE 35-continued

SARS-CoV-2 S1 Variant Variably Heavy Chain

| Name | SEQ ID NO | Amino Acid Sequence |
|---|---|---|
| 6-34 | 1985 | EVQLVESGGGLVQPGGSLRLSCAASGSAFRSNAMGWFRQAPGKEREFVAHISWS SKSTYYADSVKGRFTISADNSKNTAYLQMNSLKPEDTAVYYCATYCSSTSCFDY WGQGTLVTVSS |
| 6-35 | 1986 | EVQLVESGGGLVQPGGSLRLSCAASGFTLAYYAMGWFRQAPGKEREFVAAISMS GDDTIYADSVKGRFTISADNSKNTAYLQMNSLKPEDTAVYYCARELGYSSTVWP WGQGTLVTVSS |
| 6-36 | 1987 | EVQLVESGGGLVQPGGSLRLSCAASGFDFSVSWMGWFRQAPGKEREFVTAITWS GDSTNYADSVKGRFTISADNSKNTAYLQMNSLKPEDTAVYYCASLLHTGPSGGN YFDYWGQGTLVTVSS |
| 6-37 | 1988 | EVQLVESGGGLVQPGGSLRLSCAASGHTFSTSWMGWFRQAPGKEREFVATINSL GGTNYADSVKGRFTISADNSKNTAYLQMNSLKPEDTAVYYCARVSSGDYGMDV WGQGTLVTVSS |
| 6-38 | 1989 | EVQLVESGGGLVQPGGSLRLSCAASGNTFSGGFMGWFRQAPGKEREFVAVISSLS SKSYADSVKGRFTISADNSKNTAYLQMNSLKPEDTAVYYCAKVDSGYDYWGQG TLVTVSS |
| 6-39 | 1990 | EVQLVESGGGLVQPGGSLRLSCAASGFTFSPSWMGWFRQAPGKEREFVAAISWS GGSTAYADSVKGRFTISADNSKNTAYLQMNSLKPEDTAVYYCHGLGEGDPYGD YEGYFDLWGQGTLVTVSS |
| 6-40 | 1991 | EVQLVESGGGLVQPGGSLRLSCAASGFTFSDYWMGWFRQAPGKERELVARVW WNGGSAYYADSVKGRFTISADNSKNTAYLQMNSLKPEDTAVYYCAREVLRQQV VLDYWGQGTLVTVSS |
| 6-41 | 1992 | EVQLVESGGGLVQPGGSLRLSCAASGFTFSTSWMGWFRQAPGKEREFVASINEY GGRNYADSVKGRFTISADNSKNTAYLQMNSLKPEDTAVYYCAGLHYYYDSSGY NPTEYYGMDVWGQGTLVTVSS |
| 6-42 | 1993 | EVQLVESGGGLVQPGGSLRLSCAASGDTYGSYWMGWFRQAPGKEREFVAVITSG GSTNYADSVKGRFTISADNSKNTAYLQMNSLKPEDTAVYYCTHVQNSYYYAMD VWGQGTLVTVSS |
| 6-43 | 1994 | EVQLVESGGGLVQPGGSLRLSCAASGRTFSSYAMMGWFRQAPGKEREFVASVN WDASQINYADSVKGRFTISADNSKNTAYLQMNSLKPEDTAVYYCTTLGAVYFDS SGYHDYFDYWGQGTLVTVSS |
| 6-44 | 1995 | EVQLVESGGGLVQPGGSLRLSCAASGGTFGVYHMGWFRQAPGKEREFIGRITWT DGSTYYADSVKGRFTISADNSKNTAYLQMNSLKPEDTAVYYCFGLLEVYDMTFD YWGQGTLVTVSS |
| 6-45 | 1996 | EVQLVESGGGLVQPGGSLRLSCAASGNMFSINAMGWFRQAPGKEREFVTLISWSS GRTSYADSVKGRFTISADNSKNTAYLQMNSLKPEDTAVYYCASLGYCSGGSCFD YWGQGTLVTVSS |
| 6-46 | 1997 | EVQLVESGGGLVQPGGSLRLSCAASGLTFSAMGWFRQAPGKEREFVALIRRDGST IYADSVKGRFTISADNSKNTAYLQMNSLKPEDTAVYYCAALGILFGYDAFDIWGQ GTLVTVSS |
| 6-47 | 1998 | EVQLVESGGGLVQPGGSLRLSCAASGRTFSMHAMGWFRQAPGKERELVASITYG GNINYADSVKGRFTISADNSKNTAYLQMNSLKPEDTAVYYCAKEGYYDSTGYRT YFQQWGQGTLVTVSS |
| 6-48 | 1999 | EVQLVESGGGLVQPGGSLRLSCAASGFTVSNYAMGWFRQAPGKEREFVASVNW SGGTTSYADSVKGRFTISADNSKNTAYLQMNSLKPEDTAVYYCATTGTVTLGYW GQGTLVTVSS |
| 6-49 | 2000 | EVQLVESGGGLVQPGGSLRLSCAASGSTVLINAMGWFRQAPGKEREFVAAISWSP GRTDYADSVKGRFTISADNSKNTAYLQMNSLKPEDTAVYYCARDCSGGSCYSGD YWGQGTLVTVSS |
| 6-50 | 2001 | EVQLVESGGGLVQPGGSLRLSCAASGFSFDRWAMGWFRQAPGKEREWVASLAT GGNTNYADSVKGRFTISADNSKNTAYLQMNSLKPEDTAVYYCARVTNYDAFDI WGQGTLVTVSS |
| 6-51 | 2002 | EVQLVESGGGLVQPGGSLRLSCAASGYTYSSYVMGWFRQAPGKEREFVAAISRF GSTYYADSVKGRFTISADNSKNTAYLQMNSLKPEDTAVYYCARDSGEHFWDSG YIDHWGQGTLVTVSS |

TABLE 35-continued

SARS-CoV-2 S1 Variant Variably Heavy Chain

| Name | SEQ ID NO | Amino Acid Sequence |
|---|---|---|
| 6-52 | 2003 | EVQLVESGGGLVQPGGSLRLSCAASGDTYGSYWMGWFRQAPGKEREVVAAITS GGSTVYADSVKGRFTISADNSKNTAYLQMNSLKPEDTAVYYCARVDSRFDYWG QGTLVTVSS |
| 6-53 | 2004 | EVQLVESGGGLVQPGGSLRLSCAASGISINTNVMGWFRQAPGKEREFVAAISTGS VTIYADSVKGRFTISADNSKNTAYLQMNSLKPEDTAVYYCARVDDFGYFDLWGQ GTLVTVSS |
| 6-54 | 2005 | EVQLVESGGGLVQPGGSLRLSCAASGFEFENHWMGWFRQAPGKEREYVAHITA GGLSNYADSVKGRFTISADNSKNTAYLQMNSLKPEDTAVYYCGRHWGIYDSSGF SSFDYWGQGTLVTVSS |
| 6-55 | 2006 | EVQLVESGGGLVQPGGSLRLSCAASGFTMSSSWMGWFRQAPGKEREFVARITSG GSTGYADSVKGRFTISADNSKNTAYLQMNSLKPEDTAVYYCASVDGYFDYWGQ GTLVTVSS |
| 6-56 | 2007 | EVQLVESGGGLVQPGGSLRLSCAASGNIFRSNMGWFRQAPGKEREFVAGITWNG DTTYYADSVKGRFTISADNSKNTAYLQMNSLKPEDTAVYYCARALGVTYQFDY WGQGTLVTVSS |
| 6-57 | 2008 | EVQLVESGGGLVQPGGSLRLSCAASGLTFDDHSMGWFRQAPGKEREFVAAVPLS GNTYYADSVKGRFTISADNSKNTAYLQMNSLKPEDTAVYYCASFSGGPADFDY WGQGTLVTVSS |
| 6-58 | 2009 | EVQLVESGGGLVQPGGSLRLSCAASGRAVSTYAMGWFRQAPGKEREFVAAISGS ENVTSYADSVKGRFTISADNSKNTAYLQMNSLKPEDTAVYYCLSVTGDTEDYGV FDTWGQGTLVTVSS |
| 6-59 | 2010 | EVQLVESGGGLVQPGGSLRLSCAASGISGSVFSRTPMGWFRQAPGKEREWVSSIY SDGSNTYYADSVKGRFTISADNSKNTAYLQMNSLKPEDTAVYYCAHWSWELGD WFDPWGQGTLVTVSS |
| 6-60 | 2011 | EVQLVESGGGLVQPGGSLRLSCAASGDTYGSYWMGWFRQAPGKEREFVATISQS GAATAYADSVKGRFTISADNSKNTAYLQMNSLKPEDTAVYYCAGLLRYSGTYY DAFDVWGQGTLVTVSS |
| 6-61 | 2012 | EVQLVESGGGLVQPGGSLRLSCAASGDTYGSYWMGWFRQAPGKEREFVAAINW SGGSTNYADSVKGRFTITADNNKNTAYLQMNSLKPEDTAVYYCAGLGWNYMD YWGQGTLVTVSS |
| 6-62 | 2013 | EVQLVESGGGLVQPGGSLRLSCAASGSTFSGNWMGWFRQAPGKEREFVAVISWT GGSTYYADSVKGRFTISADNSKNTAYLQMNSLKPEDTAVYYCATHNSLSGFDYW GQGTLVTVSS |
| 6-63 | 2014 | EVQLVESGGGLVQPGGSLRLSCAASGQTFNMGWFRQAPGKEREFVAAIGSGGST SYADSVKGRFTISADNSKNTAYLQMNSLKPEDTAVYYCWRLGNDYFDYWGQGT LVTVSS |
| 6-64 | 2015 | EVQLVESGGGLVQPGGSLRLSCAASGIPSIHAMGWFRQAPGKERELVAAINWSH GVTYYADSVKGRFTISADNSKNTAYLQMNSLKPEDTAVYYCGGGYGYHFDYWG QGTLVTVSS |
| 6-65 | 2016 | EVQLVESGGGLVQPGGSLRLSCAASGLPFSTLHMGWFRQAPGKEREFVASLSIFG ATGYADSVKGRFTISADNSKNTAYLQMNSLKPEDTAVYYCWMYYYDSSGYYGN YYYGMDVWGQGTLVTVSS |
| 6-66 | 2017 | EVQLVESGGGLVQPGGSLRLSCAASGLTFSLFAMGWFRQAPGKERELVAAISSGG STDYADSVKGRFTISADNSKNTAYLQMNSLKPEDTAVYYCARGNTKYYYDSSGY SSAFDYWGQGTLVTVSS |
| 6-67 | 2018 | EVQLVESGGGLVQPGGSLRLSCAASGSFSNYAMGWFRQAPGKEREFVAAISSSG ALTSYADSVKGRFTISADNSKNTAYLQMNSLKPEDTAVYYCWIVGPGPLDGMDV WGQGTLVTVSS |
| 6-68 | 2019 | EVQLVESGGGLVQPGGSLRLSCAASGFTLSDRAMGWFRQAPGKEREYVAHITAG GLSNYADSVKGRFTISADNSKNTAYLQMNSLKPEDTAVYYCVHLASQTGAGYFD LWGQGTLVTVSS |
| 6-69 | 2020 | EVQLVESGGGLVQPGGSLRLSCAASGGTFSSVGMGWFRQAPGKEREFVAGISRS GGTYYADSVKGRFTISADNSKNTAYLQMNSLKPEDTAVYYCARYDFWSGYPYW GQGTLVTVSS |

TABLE 35-continued

SARS-CoV-2 S1 Variant Variably Heavy Chain

| Name | SEQ ID NO | Amino Acid Sequence |
|---|---|---|
| 6-70 | 2021 | EVQLVESGGGLVQPGGSLRLSCAASGFNLDDYADMGWFRQAPGKEREFVAAIG WGGGSTRYADSVKGRFTISADNSKNTAYLQMNSLKPEDTAVYYCAREILWFGEF GEPNVWGQGTLVTVSS |
| 6-71 | 2022 | EVQLVESGGGLVQPGGSLRLSCAASGITFSNDAMGWFRQAPGKEREFVAIITSSDT NDTTNYADSVKGRFTISADNSKNTAYLQMNSLKPEDTAVYYCARLHYYDSSGYF DYWGQGTLVTVSS |
| 6-72 | 2023 | EVQLVESGGGLVQPGGSLRLSCAASGSTLSINAMGWFRQAPGKEREFVAAIDWS GGSTAYADSVKGRFTISADNSKNTAYLQMNSLKPEDTAVYYCARDSSATRTGPD YWGQGTLVTVSS |
| 6-73 | 2024 | EVQLVESGGGLVQPGGSLRLSCAASGHTFSGYAMGWFRQAPGKEREFVAVITRE GSTYYADSVKGRFTISADNSKNTAYLQMNSLKPEDTAVYYCARLGGEGFDYWG QGTLVTVSS |
| 6-74 | 2025 | EVQLVESGGGLVQPGGSLRLSCAASGFAFGDSWMGWFRQAPGKERELVAAITSG GSTDYADSVKGRFTISADNSKNTAYLQMNSLKPEDTAVYYCARGLLWFGELFGY WGQGTLVTVSS |
| 6-75 | 2026 | EVQLVESGGGLVQPGGSLRLSCAASGGTFSTYWMGWFRQAPGKEREFVAAISRS GGNTYYADSVKGRFTISADNSKNTAYLQMNSLKPEDTAVYYCVRHSGTDGDSSF DYWGQGTLVTVSS |
| 6-76 | 2027 | EVQLVESGGGLVQPGGSLRLSCAASGLAFDFDGMGWFRQAPGKEREGVAAINSG GSTYYADSVKGRFTISADNSKNTAYLQMNSLKPEDTAVYYCARFFRAHDYWGQ GTLVTVSS |
| 6-77 | 2028 | EVQLVESGGGLVQPGGSLRLSCAASGFTFDRSWMGWFRQAPGKEREFVAAVTE GGTTSYADSVKGRFTISADNSKNTAYLQMNSLKPEDTAVYYCARADYDFDYWG QGTLVTVSS |
| 6-78 | 2029 | EVQLVESGGGLVQPGGSLRLSCAASGRTYDAMGWFRQAPGKEREFVASVTSGG YTHYADSVKGRFTISADNSKNTAYLQMNSLKPEDTAVYYCAKFGRKIVGATELD YWGQGTLVTVSS |
| 6-79 | 2030 | EVQLVESGGGLVQPGGSLRLSCAASGSISSIDYMGWFRQAPGKEREGVSWISSSD GSTYYADSVKGRFTISADNSKNTAYLQMNSLKPEDTAVYYCARSPSFSQIYYYYY MDVWGQGTLVTVSS |
| 6-80 | 2031 | EVQLVESGGGLVQPGGSLRLSCAASGGTFSFYNMGWFRQAPGKEREFVAFISGN GGTSYADSVKGRFTISADNSKNTAYLQMNSLKPEDTAVYYCAVVAMRMVTTEG PDVLDVWGQGTLVTVSS |
| 6-81 | 2032 | EVQLVESGGGLVQPGGSLRLSCAASGFIGNYHAMGWFRQAPGKEREFVAAVTW SGGTTNYADSVKGRFTISADNSKNTAYLQMNSLKPEDTAVYYCAREGYYYDSSG YPYYFDYWGQGTLVTVSS |
| 6-82 | 2033 | EVQLVESGGGLVQPGGSLRLSCAASGSSLDAYGMGWFRQAPGKEREFVAAISWG GGSIYYADSVKGRFTISADNSKNTAYLQMNSLKPEDTAVYYCARLSQGMVALDY WGQGTLVTVSS |
| 6-83 | 2034 | EVQLVESGGGLVQPGGSLRLSCAASGSIASIHAMGWFRQAPGKEREFVAAITWSG AITSYADSVKGRFTISADNSKNTAYLQMNSLKPEDTAVYYCAKDGGYGELHYG MEVWGQGTLVTVSS |
| 6-84 | 2035 | EVQLVESGGGLVQPGGSLRLSCAASGFTPDDYAMGWFRQAPGKEREFVAAINSG GSYTYYADSVKGRFTISADNSKNTAYLQMNSLKPEDTAVYYCARDRGPWGQGT LVTVSS |
| 6-85 | 2036 | EVQLVESGGGLVQPGGSLRLSCAASGGTFSVFAMGWFRQAPGKEREFVSAINWS GGSLLYADSVKGRFTISADNSKNTAYLQMNSLKPEDTAVYYCALFGDFDYWGQ GTLVTVSS |
| 6-86 | 2037 | EVQLVESGGGLVQPGGSLRLSCAASGPISGINRMGWFRQAPGKEREFVAVITSNG RPSYADSVKGRFTISADNSKNTAYLQMNSLKPEDTAVYYCVRLSSGYFDFDYWG QGTLVTVSS |
| 6-87 | 2038 | EVQLVESGGGLVQPGGSLRLSCAASGTSIMVGAMGWFRQAPGKEREFVAIIRGD GRTSYADSVKGRFTISADNSKNTAYLQMNSLKPEDTAVYYCARFAGWDAFDIW GQGTLVTVSS |

TABLE 35-continued

SARS-CoV-2 S1 Variant Variably Heavy Chain

| Name | SEQ ID NO | Amino Acid Sequence |
|---|---|---|
| 6-88 | 2039 | EVQLVESGGGLVQPGGSLRLSCAASGRTFSTHWMGWFRQAPGKEREFVAVINWS GGSIYYADSVKGRFTISADNSKNTAYLQMNSLKPEDTAVYYCARLSSDGYNYFD FWGQGTLVTVSS |
| 6-89 | 2040 | EVQLVESGGGLVQPGGSLRLSCAASGTIFASAMGWFRQAPGKEHQFVAWNWN GSSTVYADNVKGRFTIIADNSKNTAYLQMNSLKPEDTAVYYCTTVDQYFNYWG QGTLVTVSS |
| 6-90 | 2041 | EVQLVESGGGLVQPGGSLRLSCAASGFPFSIWPMGWFRQAPGKEREFVAAVRWS STYYADSVKGRFTISADNSKNTAYLQMNSLKPEDTAVYYCATGECDGGSCSLAY WGQGTLVTVSS |
| 6-91 | 2042 | EVQLVESGGGLVQPGGSLRLSCAASGRTFGNYAMGWFRQAPGKEREFVASISSS GVSKHYADSVKGRFTISADNSKNTAYLQMNSLKPEDTAVYYCVRFGSSWARDL DQWGQGTLVTVSS |
| 6-92 | 2043 | EVQLVESGGGLVQPGGSLRLSCAASGFLFDSYASMGWFRQAPGKEREFVATIWR RGNTYYANYADSVKGRFTISADNSKNTAYLQMNSLKPEDTAVYYCTETGTAAW GQGTLVTVSS |
| 6-93 | 2044 | EVQLVESGGGLVQPGGSLRLSCAASGLPFSTKSMGWFRQAPGKEREFVAAISMSG LTSYADSVKGRFTISADNSKNTAYLQMNSLKPEDTAVYYCLKVLGGDYEADNW FDYWGQGTLVTVSS |
| 6-94 | 2045 | EVQLVESGGGLVQPGGSLRLSCAASGNIFRIETMGWFRQAPGKEREFVAGIIRSGG ETLYADSVKGRFTISADNSKNTAYLQMNSLKPEDTAVYYCARSLYYDRSGSYYF DYWGQGTLVTVSS |
| 6-95 | 2046 | EVQLVESGGGLVQPGGSLRLSCAASGIPSSIRAMGWFRQAPGKEREFVAVIRWTG GSTYYADSVKGRFTISADNSKNTAYLQMNSLKPEDTAVYYCARDIGYYDSSGYY NDGGFDYWGQGTLVTVSS |
| 6-96 | 2047 | EVQLVESGGGLVQPGGSLRLSCAASGFTLSGNWMGWFRQAPGKEREFVAIITSG GRTNYADSVKGRFTISADNSKNTAYLQMNSLKPEDTAVYYCAGHATFGGSSSSY YYGMDVWGQGTLVTVSS |
| 6-97 | 2048 | EVQLVESGGGLVQPGGSLRLSCAASGFTFSSLAMGWFRQAPGKEREFVAAITWS GDITNYADSVKGRFTIADNSKNTAYLQMNSLKPEDTAVYYCLRLSSSGFDHWG QGTLVTVSS |
| 6-98 | 2049 | EVQLVESGGGLVQPGGSLRLSCAASGTFGHYAMGWFRQAPGKEREFVAAINWSS RSTVYADSVKGRFTIADNSKNTAYLQMNSLKPEDTAVYYCAKSDGLMGELRSA SAFDIWGQGTLVTVSS |
| 6-99 | 2050 | EVQLVESGGGLVQPGGSLRLSCAASGIPFRSRTMGWFRQAPGKEREFVAGISRSG ASTAYADSVKGRFTISADNSKNTAYLQMNSLKPEDTAVYYCTHANDYGDYWGQ GTLVTVSS |
| 6-100 | 2051 | EVQLVESGGGLVQPGGSLRLSCAASGGTFSTSWMGWFRQAPGKEREYVAHITAG GLSNYADSVKGRFTISADNSKNTAYLQMNSLKPEDTAVYYCARLLVREDWYFDL WGQGTLVTVSS |
| 6-101 | 2052 | EVQLVESGGGLVQPGGSLRLSCAASGGTFSLFAMGWFRQAPGKEREFVAAISWT GDSTYYKYYADSVKGRFTISADNSKNTAYLQMNSLKPEDTAVYYCAYNNSSGE YWGQGTLVTVSS |
| 6-102 | 2053 | EVQLVESGGGLVQPGGSLRLSCAASGSSFSAYAMGWFRQAPGKEREFVSAIDSEG TTTYADSVKGRFTISADNSKNTAYLQMNSLKPEDTAVYYCAGDYNFWSGFDHW GQGTLVTVSS |
| 6-103 | 2054 | EVQLVESGGGLVQPGGSLRLSCAASGRTSSPIAMGWFRQAPGKEREPVAVRWSD DYTYYADSVKGRFTISADNSKNTAYLQMNSLKPEDTAVYYCAKKLGGYYAFDI WGQGTLVTVSS |
| 6-104 | 2055 | EVQLVESGGGLVQPGGSLRLSCAASGLTFNQYTMGWFRQAPGKEREFVASITDG GSTYYADSVKGRFTISADNSKNTAYLQMNSLKPEDTAVYYCARDSRYMDVWGQ GTLVTVSS |
| 6-105 | 2056 | EVQLVESGGGLVQPGGSLRLSCAASGPTFSSMGWFRQAPGKEREFVAAISWDGG ATAYADSVKGRFTISADNSKNTAYLQMNSLKPEDTAVYYCAIEIVVGGIYWGQG TLVTVSS |

TABLE 35-continued

SARS-CoV-2 S1 Variant Variably Heavy Chain

| Name | SEQ ID NO | Amino Acid Sequence |
|---|---|---|
| 6-106 | 2057 | EVQLVESGGGLVQPGGSLRLSCAASGIPSTLRAMGWFRQAPGKEREFVAATSWS GGSKYYADSVKGRFTISADNSKNTAYLQMNSLKPEDTAVYYCATDLYYMDVW GQGTLVTVSS |
| 6-107 | 2058 | EVQLVESGGGLVQPGGSLRLSCAASGGVGFSVTNMGWFRQAPGKEREFVAVISS SSSTNYADSVKGRFTISADNSKNTAYLQMNSLKPEDTAVYYCTTFNWNDEGFDY WGQGTLVTVSS |
| 6-108 | 2059 | EVQLVESGGGLVQPGGSLRLSCAASGGTFGSYGMGWFRQAPGKEREFVAAIRWS GGITYYADSVKGRFTISADNSKNTAYLQMNSLKPEDTAVYYCARERYWNPLPYY YYGMDVWGQGTLVTVSS |
| 6-109 | 2060 | EVQLVESGGGLVQPGGSLRLSCAASGGTFSTYAMGWFRQVPGKEREFVASIDWS GLTSYADSVKGRFTISADNSKNTAYLQMNSLKPEDTAVYYCARGPFYMYCSGTK CYSTNWFDPWGQGTLVTVSS |
| 6-110 | 2061 | EVQLVESGGGLVQPGGSLRLSCAASGPIYAVNRMGWFRQAPGKEREFVAGIWRS GGHRDYADSVKGRFTISADNSKNTAYLQMNSLKPEDTAVYYCARGEIDILTGYW YDYWGQGTLVTVSS |
| 6-111 | 2062 | EVQLVESGGGLVQPGGSLRLSCAASGFTFSNYWMGWFRQAPGKEREFVGGISRS GVSTSYADSVKGRFTISADNSKNTAYLQMNSLKPEDTAVYYCTTLLYYYDSSGY SFDAFDIWGQGTLVTVSS |
| 6-112 | 2063 | EVQLVESGGGLVQPGGSLRLSCAASGGTFSAYHMGWFRQAPGKERELVTIIDNG GPTSYADSVKGRFTISADNSKNTAYLQMNSLKPEDTAVYYCTALLYYFDNSGYN FDPFDIWGQGTLVTGSS |

TABLE 36

Reformatted SARS-CoV-2 S1 Variant Sequences

| Name | SEQ ID NO | Amino Acid Sequence |
|---|---|---|
| 2-H1 | 2064 | EVQLLESGGGLVQPGGSLRLSCAASGFTFSNYATDWVRQAPGKGLEWVSIISGSG GATYYADSVKGRFTISRDNSKNTLYLQMNSLRAEDTAVYYCAKGGYCSSDTCW WEYWLDPWGQGTLVTVSS |
| 2-H2 | 2065 | EVQLLESGGGLVQPGGSLRLSCAASGFTFSAFAMGWVRQAPGKGLEWVSAITASG DITYYADSVKGRFTISRDNSKNTLYLQMNSLRAEDTAVYYCARQSDGLPSPWHFD LGGQGTLVTVSS |
| 2-H3 | 2066 | EVQLLESGGGLVQPGGSLRLSCAASGFTFSDFAMAWVRQAPGKGLEWVSAISGSG DITYYADSVKGRFTISRDNSKNTLYLQMNSLRAEDTAVYYCAREADGLHSPWHFD LWGQGTLVTVSS |
| 2-H4 | 2067 | EVQLLESGGGLVQPGGSLRLSCAASGFTFSRHAMNWVRQAPGKGLEWVSGISGSG DETYYADSVKGRFTISRDNSKNTLYLQMNSLRAEDTAVYYCARDLPASYYDSSGY YWHNGMDVWGQGTLVTVSS |
| 2-H5 | 2068 | EVQLLESGGGLVQPGGSLRLSCAASGFTFSDFAMAWVRQAPGKGLEWVSAISGSG DITYYADSVKGRFTISRDNSKNTLYLQMNSLRAEDTAVYYCAREADCLPSPWYLD LWGQGTLVTVSS |
| 2-H6 | 2069 | EVQLLESGGGLVQPGGSLRLSCAASGFTFSDFAMAWVRQAPGKGLEWVSAISGSG DITYYADSVKGRFTISRDNSKNTLYLQMNSLRAEDTAVYYCAREADGLHSPWHFD LWGQGTLVTVSS |
| 2-H7 | 2070 | EVQLLESGGGLVQPGGSLRLSCAASGFTFSNYPMNWVRQAPGKGLEWVSTISGSG GNTFYADSVKGRFTISRDNSKNTLYLQMNSLRAEDTAVYYCVRHDEYSFDYWGQ GTLVTVSS |
| 2-H8 | 2071 | EVQLLESGGGLVQPGGSLRLSCAASGFTFSDFAMAWVRQAPGKGLEWVSAITGSG DITYYADSVKGRFTISRDNSKNTLYLQMNSLRAEDTAVYYCAREADGLHSPWHFD LWGQGTLVTVSS |
| 2-H9 | 2072 | EVQLLESGGGLVQPGGSLRLSCAASGFTFSDYPMNWVRQAPGKGLEWVSTISGSG GITFYADSVKGRFTISRDNSKNTLYLQMNSLRAEDTAVYYCVRHDEYSFDYWGQ GTLVTVSS |

TABLE 36-continued

Reformatted SARS-CoV-2 S1 Variant Sequences

| Name | SEQ ID NO | Amino Acid Sequence |
|---|---|---|
| 2-H10 | 2073 | EVQLLESGGGLVQPGGSLRLSCAASGFTFSDYPMNWVRQAPGKGLEWVSAISGSGDNTYYADSVKGRFTISRDNSKNTLYLQMNSLRAEDTAVYYCVRHDEYSFDYWGQGTLVTVSS |
| 2-H11 | 2074 | EVQLLESGGGLVQPGGSLRLSCAASGFTFSDFAMAWVRQAPGKGLEWVSAITGTGDITYYADSVKGRFTISRDNSKNTLYLQMNSLRAEDTAVYYCAREADGLHSPWGQGTLVTVSS |
| 2-H12 | 2075 | EVQLLESGGGLVQPGGSLRLSCAASGFTFSDYPMNWVRQAPGKGLEWVSAITGSGDITYYADSVKGRFTISRDNSKNTLYLQMNSLRAEDTAVYYCVRHDEYSFDYWGQGTLVTVSS |
| 2-H13 | 2076 | EVQLLESGGGLVQPGGSLRLSCAASGFTFSDFAMAWVRQAPGKGLEWVSAISGSGDITYYADSVKGRFTISRDNSKNTLYLQMNSLRAEDTAVYYCAREADGLHSPWHFDLWGQGTLVTVSS |
| 2-H14 | 2077 | EVQLLESGGGLVQPGGSLRLSCAASGFTFSDFAMAWVRQAPGKGLEWVSAISGSGDITYYADSVKGRFTISRDNSKNTLYLQMNSLRAEDTAVYYCAREADGLHSPWHFDLWGQGTLVTVSS |
| 2-H15 | 2078 | EVQLLESGGGLVQPGGSLRLSCAASGFTFPRYAMSWVRQAPGKGLEWVSTISGSGSTTYYADSVKGRFTISRDNSKNTLYLQMNSLRAEDTAVYYCARLIDAFDIWGQGTLVTVSS |
| 2-L1 | 2079 | DIQMTQSPSSLSASVGDRVTITCRASQSIHRFLNWYQQKPGKAPKLLIYAASNLHSGVPSRFSGSGSGTDFTLTISSLQPEDFATYYCQQSYGLPPTFGQGTKVEIK |
| 2-L2 | 2080 | DIQMTQSPSSLSASVGDRVTITCRASQSIHISLNWYQQKPGKAPKLLIYLASPLASGVPSRFSGSGSGTDFTLTISSLQPEDFATYYCQQSYSAPPYTFGQGTKVEIK |
| 2-L3 | 2081 | DIQMTQSPSSLSASVGDRVTITCRASQSIHTYLNWYQQKPGKAPKLLIYAASALASGVPSRFSGSGSGTDFTLTISSLQPEDFATYYCQQSYSAPPYTFGQGTKVEIK |
| 2-L4 | 2082 | DIQMTQSPSSLSASVGDRVTITCRASQTINTYLNWYQQKPGKAPKLLIYSASTLQSGVPSRFSGSGSGTDFTLTISSLQPEDFATYYCQQSYSTFTFGQGTKVEIK |
| 2-L5 | 2083 | DIQMTQSPSSLSASVGDRVTITCRASQNIHTYLNWYQQKPGKAPKLLIYAASTFAKGVPSRFSGSGSGTDFTLTISSLQPEDFATYYCQQSYSAPPYTFGQGTKVEIK |
| 2-L6 | 2084 | DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK |
| 2-L7 | 2085 | DIQMTQSPSSLSASVGDRVTITCRASQSIGNYLNWYQQKPGKAPKLLIYGVSSLQSGVPSRFSGSGSGTDFTLTISSLQPEDFATYYCQQSHSAPLTFGQGTKVEIK |
| 2-L8 | 2086 | DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK |
| 2-L9 | 2087 | DIQMTQSPSSLSASVGDRVTITCRASQSIDNYLNWYQQKPGKAPKLLIYGVSALQSGVPSRFSGSGSGTDFTLTISSLQPEDFATYYCQQSHSAPPYFFGQGTKVEIK |
| 2-L10 | 2088 | DIQMTQSPSSLSASVGDRVTITCRASQSIDTYLNWYQQKPGKAPKLLIYGASALESGVPSRFSGSGSGTDFTLTISSLQPEDFATYYCQQSHSAPPYFFGQGTKVEIK |
| 2-L11 | 2089 | DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK |
| 2-L12 | 2090 | DIQMTQSPSSLSASVGDRVTITCRASQSIDTYLNWYQQKPGKAPKLLIYGVSALQSGVPSRFSGSGSGTDFTLTISSLQPEDFATYYCQQSYSAPPYFFGQGTKVEIK |
| 2-L13 | 2091 | DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK |
| 2-L14 | 2092 | DIQMTQSPSSLSASVGDRVTITCRASQSIDNYLNWYQQKPGKAPKLLIYGVSALQSGVPSRFSGSGSGTDFTLTISSLQPEDFATYYCQQSHSAPLTFGQGTKVEIK |
| 2-L15 | 2093 | DIQMTQSPSSLSASVGDRVTITCRASQRIGTYLNWYQQKPGKAPKLLIYAASNLEGGVPSRFSGSGSGTDFTLTISSLQPEDFATYYCQQNYSTTWTFGQGTKVEIK |
| 2-H16 | 2094 | EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCAREGYRDYLWYFDLWGQGTLVTVSS |

TABLE 36-continued

| Reformatted SARS-CoV-2 S1 Variant Sequences | | |
|---|---|---|
| Name | SEQ ID NO | Amino Acid Sequence |
| 2-H17 | 2095 | EVQLLESGGGLVQPGGSLRLSCAASGFTFSNYAMSWVRQAPGKGLEWVSAISGSAGSTYYADSVKGRFTISRDNSKNTLYLQMNSLRAEDTAVYYCARVRQGLRRTWYYFDYWGQGTLVTVSS |
| 2-H18 | 2096 | EVQLLESGGGLVQPGGSLRLSCAASGFTFSSYAMYWVRQAPGKGLEWVSAISGSAGSTYYADSVKGRFTISRDNSKNTLYLQMNSLRAEDTAVYYCARDTNDFWSGYSIFDPWGQGTLVTVSS |
| 2-H19 | 2097 | EVQLLESGGGLVQPGGSLRLSCAASGFTFSSYTMSWVRQAPGKGLEWVSVISGSGGSTYYADSVKGRFTISRDNSKNTLYLQMNSLRAEDTAVYYCAREGYRDYLWYFDLWGQGTLVTVSS |
| 2-H20 | 2098 | EVQLLESGGGLVQPGGSLRLSCAASGFTFSSYDMSWVRQAPGKGLEWVSVISGSGGSTYYADSVKGRFTISRDNSKNTLYLQMNSLRAEDTAVYYCAKGPLVGWYFDLWGQGTLVTVSS |
| 2-L16 | 2099 | DIQMTQSPSSLSASVGDRVTITCTGTSSDVGSYDLVSWYQQKPGKAPKLLIYEGNKRPSGVPSRFSGSGSGTDFTLTISSLQPEDFATYYCCSYAGSSVVFGQGTKVEIK |
| 2-L17 | 2100 | DIQMTQSPSSLSASVGDRVTITCTGTSSDVGSSNLVSWYQQKPGKAPKLLIYEGSKRPSGVPSRFSGSGSGTDFTLTISSLQPEDFATYYCCSYAGSLYVFGQGTKVEIK |
| 2-L18 | 2101 | DIQMTQSPSSLSASVGDRVTITCTGTSSDIGSYNLVSWYQQKPGKAPKLLIYEGTKRPSGVPSRFSGSGSGTDFTLTISSLQPEDFATYYCCSYAGSRTYVFGQGTKVEIK |
| 2-L19 | 2102 | DIQMTQSPSSLSASVGDRVTITCTGTSTDVGSYNLVSWYQQKPGKAPKLLIYEGTKRPSGVPSRFSGSGSGTDFTLTISSLQPEDFATYYCCSYAGSYTSVVFGQGTKVEIK |
| 2-L20 | 2103 | DIQMTQSPSSLSASVGDRVTITCSSNVGSYNLVSWYQQKPGKAPKLLIYEGTKRPSGVPSRFSGSGSGTDFTLTISSLQPEDFATYYCCSYAGSSSFVVFGQGTKVEIK |

TABLE 37

| Reformatted ACE2 Variant Sequences | | |
|---|---|---|
| Name | SEQ ID NO | Amino Acid Sequence |
| 3-H1 | 2104 | EVQLLESGGGLVQPGGSLRLSCAASGFTFRSHAMSWVRQAPGKGLEWVSSISGGGASTYYADSVKGRFTISRDNSKNTLYLQMNSLRAEDTAVYYCARVKYLTTSSGWPRPYFDNWGQGTLVTVSS |
| 3-H2 | 2105 | EVQLLESGGGLVQPGGSLRLSCAASGFTFSAYSMSWVRQAPGKGLEWVSAISGSGGSRYYADSVKGRFTISRDNSKNTLYLQMNSLRAEDTAVYYCGRSKWPQANGAFDIWGQGTLVTVSS |
| 3-H3 | 2106 | EVQLLESGGGLVQPGGSLRLSCAASGFMFGNYAMSWVRQAPGKGLEWVAAISGSGGSTYYADSVKGRFTISRDNSKNTLYLQMNSLRAEDTAVYYCAKDRGYSSSWYGGFDYWGQGTLVTVSS |
| 3-H4 | 2107 | EVQLLESGGGLVQPGGSLRLSCAASGFTFRNHAMAWVRQAPGKGLEWVSGISGSGGTTYYGDSVKGRFTISRDNSKNTLYLQMNSLRAEDTAVYYCARGTRFLQWSLPLDVWGQGTLVTVSS |
| 3-H5 | 2108 | EVQLLESGGGLVQPGGSLRLSCAASGFTIPNYAMSWVRQAPGKGLEWVSGISGAGASTYYADSVKGRFTISRDNSKNTLYLQMNSLRAEDTAVYYCARHTWWKGAGFFDHWGQGTLVTVSS |
| 3-H6 | 2109 | EVQLLESGGGLVQPGGSLRLSCAASGFTFRNYAMAWVRQAPGKGLEWVSGISGSGGTTYYGDSVKGRFTISRDNSKNTLYLQMNSLRAEDTAVYYCARGTRFLEWSLPLDVWGQGTLVTVSS |
| 3-H7 | 2110 | EVQLLESGGGLVQPGGSLRLSCAASGFTIRNYAMSWVRQAPGKGLEWVSSISGGGASTYYADSVKGRFTISRDNSKNTLYLQMNSLRAEDTAVYYCARVKYLTTSSGWPRPYFDNWGQGTLVTVSS |
| 3-H8 | 2111 | EVQLLESGGGLVQPGGSLRLSCAASGFTIPNYAMSWVRQAPGKGLEWVSGISGSGASTYYADSVKGRFTISRDNSKNTLYLQMNSLRAEDTAVYYCARHTWWKGAGFFDHWGQGTLVTVSS |

TABLE 37-continued

Reformatted ACE2 Variant Sequences

| Name | SEQ ID NO | Amino Acid Sequence |
|---|---|---|
| 3-H9 | 2112 | EVQLLESGGGLVQPGGSLRLSCAASGFTITNYAMSWVRQAPGKGLEWVSGISGSG AGTYYADSVKGRFTISRDNSKNTLYLQMNSLRAEDTAVYYCARHAWWKGAGFF DHWGQGTLVTVSS |
| 3-H10 | 2113 | EVQLLESGGGLVQPGGSLRLSCAASGFTFRSHAMSWVRQAPGKGLEWVSSISGGG ASTYYADSVKGRFTISRDNSKNTLYLQMNSLRAEDTAVYYCARVKYLTTSSGWPR PYFDNWGQGTLVTVSS |
| 3-H11 | 2114 | EVQLLESGGGLVQPGGSLRLSCAASGFTITNYAMSWVRQAPGKGLEWVSGISGSG AGTYYADSVKGRFTISRDNSKNTLYLQMNSLRAEDTAVYYCARHTWWKGAGFFD HWGQGTLVTVSS |
| 3-H12 | 2115 | EVQLLESGGGLVQPGGSLRLSCAASGFTFRSHAMNWVRQAPGKGLEWVSAISGSG GSTNYADSVKGRFTISRDNSKNTLYLQMNSLRAEDTAVYYCARGLKFLEWLPSAF DIWGQGTLVTVSS |
| 3-H13 | 2116 | EVQLLESGGGLVQPGGSLRLSCAASGFTFRSHAMSWVRQAPGKGLEWVSSISGGG ASTYYADSVKGRFTISRDNSKNTLYLQMNSLRAEDTAVYYCARVKYLTTSSGWPR PYFDNWGQGTLVTVSS |
| 3-H14 | 2117 | EVQLLESGGGLVQPGGSLRLSCAASGFTFRSYAMSWVRQAPGKGLEWVSSISGGG ASTYYADSVKGRFTISRDNSKNTLYLQMNSLRAEDTAVYYCARVKYLTTSSGWPR PYFDNWGQGTLVTVSS |
| 3-H15 | 2118 | EVQLLESGGGLVQPGGSLRLSCAASGFTITNYAMSWVRQAPGKGLEWVSGISGSG AGTYYADSVKGRFTISRDNSKNTLYLQMNSLRAEDTAVYYCARHTWWKGAGFFD HWGQGTLVTVSS |
| 3-L1 | 2119 | DIQMTQSPSSLSASVGDRVTITCRASQSIRKYLNWYQQKPGKAPKLLIYASSTLQRG VPSRFSGSGSGTDFTLTISSLQPEDFATYYCQQSLSTPFTFGQGTKVEIK |
| 3-L2 | 2120 | DIQMTQSPSSLSASVGDRVTITCRASQNIKTYLNWYQQKPGKAPKLLIYAASKLQS GVPSRFSGSGSGTDFTLTISSLQPEDFATYYCQQSYSTSPTFGQGTKVEIK |
| 3-L3 | 2121 | DIQMTQSPSSLSASVGDRVTITCRASQTIYSYLNWYQQKPGKAPKLLIYATSTLQGG VPSRFSGSGSGTDFTLTISSLQPEDFATYYCQHRGTFGQGTKVEIK |
| 3-L4 | 2122 | DIQMTQSPSSLSASVGDRVTITCRASRSIRRYLNWYQQKPGKAPKLLIYASSSLQAG VPSRFSGSGSGTDFTLTISSLQPEDFATYYCQQSYSTLLTFGQGTKVEIK |
| 3-L5 | 2123 | DIQMTQSPSSLSASVGDRVTITCRASQSIGKYLNWYQQKPGKAPKLLIYASSSLQSG VPSRFSGSGSGTDFTLTISSLQPEDFATYYCQQSYSPPFTFGQGTKVEIK |
| 3-L6 | 2124 | DIQMTQSPSSLSASVGDRVTITCRASRSISRYLNWYQQKPGKAPKLLIYAASSLQAG VPSRFSGSGSGTDFTLTISSLQPEDFATYYCQQSYSSLLTFGQGTKVEIK |
| 3-L7 | 2125 | DIQMTQSPSSLSASVGDRVTITCRASQSIGKYLNWYQQKPGKAPKLLIYASSTLQRG VPSRFSGSGSGTDFTLTISSLQPEDFATYYCQQSLSPPFTFGQGTKVEIK |
| 3-L8 | 2126 | DIQMTQSPSSLSASVGDRVTITCRASQSIGRYLNWYQQKPGKAPKLLIYASSSLQSG VPSRFSGSGSGTDFTLTISSLQPEDFATYYCQQSYSLPRTFGQGTKVEIK |
| 3-L9 | 2127 | DIQMTQSPSSLSASVGDRVTITCRASQSIGRYLNWYQQKPGKAPKLLIYAASSLKSG VPSRFSGSGSGTDFTLTISSLQPEDFATYYCQQSYSLPRTFGQGTKVEIK |
| 3-L10 | 2128 | DIQMTQSPSSLSASVGDRVTITCRASQSIGKYLNWYQQKPGKAPKLLIYASSTLQRG VPSRFSGSGSGTDFTLTISSLQPEDFATYYCQQSLSTPFTFGQGTKVEIK |
| 3-L11 | 2129 | DIQMTQSPSSLSASVGDRVTITCRASQSIGRYLNWYQQKPGKAPKLLIYAASSLKSG VPSRFSGSGSGTDFTLTISSLQPEDFATYYCQQSYSLPLTFGQGTKVEIK |
| 3-L12 | 2130 | DIQMTQSPSSLSASVGDRVTITCRTSQSINTYLNWYQQKPGKAPKLLIYGASNVQS GVPSRFSGSGSGTDFTLTISSLQPEDFATYYCQQSYRIPRTFGQGTKVEIK |
| 3-L13 | 2131 | DIQMTQSPSSLSASVGDRVTITCRASQSIGKYLNWYQQKPGKAPKLLIYASSTLQRG VPSRFSGSGSGTDFTLTISSLQPEDFATYYCQQSFSPPFTFGQGTKVEIK |
| 3-L14 | 2132 | DIQMTQSPSSLSASVGDRVTITCRASQSIGKYLNWYQQKPGKAPKLLIYASSTLQRG VPSRFSGSGSGTDFTLTISSLQPEDFATYYCQQSFSTPFTFGQGTKVEIK |
| 3-L15 | 2133 | DIQMTQSPSSLSASVGDRVTITCRASQSIGRYLNWYQQKPGKAPKLLIYAASSLKSG VPSRFSGSGSGTDFTLTISSLQPEDFATYYCQQSYSLPRTFGQGTKVEIK |

TABLE 37-continued

Reformatted ACE2 Variant Sequences

| Name | SEQ ID NO | Amino Acid Sequence |
|---|---|---|
| 3-H16 | 2134 | EVQLLESGGGLVQPGGSLRLSCAASGFTFTNFAMSWVRQAPGKGLEWVSAISGRG GGTYYADSVKGRFTISRDNSKNTLYLQMNSLRAEDTAVYYCARD AHGYYYDSSG YDDWGQGTLVTVSS |
| 3-H17 | 2135 | EVQLLESGGGLVQPGGSLRLSCAASGFTFRSYPMSWVRQAPGKGLEWVSTISGSG GITYYADSVKGRFTISRDNSKNTLYLQMNSLRAEDTAVYYCAKGVYGSTVTTCH WGQGTLVTVSS |
| 3-H18 | 2136 | EVQLLESGGGLVQPGGSLRLSCAASGFTLTSYAMSWVRQAPGKGLEWVSAISGSG VDTYYADSVKGRFTISRDNSKNTLYLQMNSLRAEDTAVYYCARPTNWGFDYWGQ GTLVTVSS |
| 3-H19 | 2137 | EVQLLESGGGLVQPGGSLRLSCAASGFTFINYAMSWVRQAPGKGLEWVSTISTSGG NTYYADSVKGRFTISRDNSKNTLYLQMNSLRAEDTAVYYCARADSNWASSAYWG QGTLVTVSS |
| 3-H20 | 2138 | EVQLLESGGGLVQPGGSLRLSCAASGFPFSTYAMSWVRQAPGKGLEWVSGISVSG GFTYYADSVKGRFTISRDNSKNTLYLQMNSLRAEDTAVYYCARDPYSYGYYYYY GMDVWGQGTLVTVSS |
| 3-H21 | 2139 | EVQLLESGGGLVQPGGSLRLSCAASGFTFSTYAMGWVRQAPGKGLEWVSGISGGG VSTYYADSVKGRFTISRDNSKNTLYLQMNSLRAEDTAVYYCARARNWGPSDYWG QGTLVTVSS |
| 3-H22 | 2140 | EVQLLESGGGLVQPGGSLRLSCAASGFIFSDYAMTWVRQAPGKGLEWVSAISGSA FYADSVKGRFTISRDNSKNTLYLQMNSLRAED TAVYYCARDATYSSSWYNWFDP WGQGTLVTVSS |
| 3-H23 | 2141 | EVQLLESGGGLVQPGGSLRLSCAASGFTFSDYAMTWVRQAPGKGLEWVSDISGSG GSTYYADSVKGRFTISRDNSKNTLYLQMNSLRAEDTAVYYCARGTVTSFDFWGQ GTLVTVSS |
| 3-H24 | 2142 | EVQLLESGGGLVQPGGSLRLSCAASGFTFSIYAMGWVRQAPGKGLEWVSFISGSG GSTYYADSVKGRFTISRDNSKNTLYLQMNSLRAEDTAVYYCAKDYHSASWFSAA ADYWGQGTLVTVSS |
| 3-H25 | 2143 | EVQLLESGGGLVQPGGSLRLSCAASGFTFASYAMTWVRQAPGKGLEWVSAISESG GSTYYADSVKGRFTISRDNSKNTLYLQMNSLRAEDTAVYYCAREGQEYSSGSSYF DYWGQGTLVTVSS |
| 3-H26 | 2144 | EVQLLESGGGLVQPGGSLRLSCAASGFTFSEYAMSWVRQAPGKGLEWVSAITGSG GSTYYGDSVKGRFTISRDNSKNTLYLQMNSLRAEDTAVYYCARGSQTPYCGGDCP ETFDYWGQGTLVTVSS |
| 3-H27 | 2145 | EVQLLESGGGLVQPGGSLRLSCAASGFTFDDYAMSWVRQAPGKGLEWVSGISGG GTSTYYADSVKGRFTISRDNSKNTLYLQMNSLRAEDTAVYYCARDLYSSGWYGF DYWGQGTLVTVSS |
| 3-H28 | 2146 | EVQLLESGGGLVQPGGSLRLSCAASGFTFNNYAMNWVRQAPGKGLEWVSAISGS VGSTYYADSVKGRFTISRDNSKNTLYLQMNSLRAEDTAVYYCARDNYDFWSGYY TNWFDPWGQGTLVTVSS |
| 3-H29 | 2147 | EVQLLESGGGLVQPGGSLRLSCAASGFTFTNHAMSWVRQAPGKGLEWVSAISGSG SNIYYADSVKGRFTISRDNSKNTLYLQMNSLRAEDTAVYYCARDSLSVTMGRGVV TYYYYGMDFWGQGTLVTVSS |
| 3-L16 | 2148 | DIQMTQSPSSLSASVGDRVTITCRASQIIGSYLNWYQQKPGKAPKLLIYTTSNLQSG VPSRFSGSGSGTDFTLTISSLQPEDFATYYCQQSYITPWTFGQGTKVEIK |
| 3-L17 | 2149 | DIQMTQSPSSLSASVGDRVTITCRASQSISRYINWYQQKPGKAPKLLIYEASSLESGV PSRFSGSGSGTDFTLTISSLQPEDFATYYCQQSHITPLTFGQGTKVEIK |
| 3-L18 | 2150 | DIQMTQSPSSLSASVGDRVTITCRASQSIYTYLNWYQQKPGKAPKLLIYSASNLHSG VPSRFSGSGSGTDFTLTISSLQPEDFATYYCQQSDTTPWTFGQGTKVEIK |
| 3-L19 | 2151 | DIQMTQSPSSLSASVGDRVTITCRASQSIATYLNWYQQKPGKAPKLLIYGASSLEGG VPSRFSGSGSGTDFTLTISSLQPEDFATYYCQQTFSSPFTFGQGTKVEIK |
| 3-L20 | 2152 | DIQMTQSPSSLSASVGDRVTITCRASQNINTYLNWYQQKPGKAPKWYSASSLQSG VPSRFSGSGSGTDFTLTISSLQPEDFATYYCQQSSLTPWTFGQGTKVEIK |
| 3-L21 | 2153 | DIQMTQSPSSLSASVGDRVTITCRASQGIATYLNWYQQKPGKAPKLLIYYASNLQS GVPSRFSGSGSGTDFTLTISSLQPEDFATYYCQQSYSTRFTFGQGTKVEIK |

TABLE 37-continued

Reformatted ACE2 Variant Sequences

| Name | SEQ ID NO | Amino Acid Sequence |
|---|---|---|
| 3-L22 | 2154 | DIQMTQSPSSLSASVGDRVTITCRASERISNYLNWYQQKPGKAPKLLIYTASNLESG VPSRFSGSGSGTDFTLTISSLQPEDFATYYCQQSYTPPRTFGQGTKVEIK |
| 3-L23 | 2155 | DIQMTQSPSSLSASVGDRVTITCRASQSISSSLNWYQQKPGKAPKLLIYAASRLQDG VPSRFSGSGSGTDFTLTISSLQPEDFATYYCQQSYSTPRSFGQGTKVEIK |
| 3-L24 | 2156 | DIQMTQSPSSLSASVGDRVTITCRASQSISSHLNWYQQKPGKAPKLLIYRASTLQSG VPSRFSGSGSGTDFTLTISSLQPEDFATYYCQQTYNTPQTFGQGTKVEIK |
| 3-L25 | 2157 | DIQMTQSPSSLSASVGDRVTITCRASQSISSYLIWYQQKPGKAPKLLIYAASRLHSG VPSRFSGSGSGTDFTLTISSLQPEDFATYYCQQGYNTPRTFGQGTKVEIK |
| 3-L26 | 2158 | DIQMTQSPSSLSASVGDRVTITCRASPSISTYLNWYQQKPGKAPKLLIYTASRLQTG VPSRFSGSGSGTDFTLTISSLQPEDFATYYCQQYSTPSSFGQGTKVEIK |
| 3-L27 | 2159 | DIQMTQSPSSLSASVGDRVTITCRASQNIAKYLNWYQQKPGKAPKLLIYGASGLQS GVPSRFSGSGSGTDFTLTISSLQPEDFATYYCQQSHSPPITFGQGTKVEIK |
| 3-L28 | 2160 | DIQMTQSPSSLSASVGDRVTITCRASQSIGTYLNWYQQKPGKAPKLLIYAASNLHS GVPSRFSGSGSGTDFTLTISSLQPEDFATYYCQESYSAPYTFGQGTKVEIK |
| 3-L29 | 2161 | DIQMTQSPSSLSASVGDRVTITCRASQSISPYLNWYQQKPGKAPKLLIYKASSLQSG VPSRFSGSGSGTDFTLTISSLQPEDFATYYCQQSSSTPYTFGQGTKVEIK |

TABLE 38

Reformatted ACE2 Variant Sequences

| Name | SEQ ID NO | Amino Acid Sequence |
|---|---|---|
| 4-51 | 2162 | EVQLVESGGGLVQPGGSLRLSCAASGPGTAIMGWFRQAPGKEREFVARISTSGGST KYADSVKGRFTISADNSKNTAYLQMNSLKPEDTAVYYCARTTVTTPPLIWGQGTL VTVSS |
| 4-52 | 2163 | EVQLVESGGGLVQPGGSLRLSCAASGRSFSNSVMGWFRQAPGKEREFVARITWNG GSTYYADSVKGRFTISADNSKNTAYLQMNSLKPEDTAVYYCATTENPNPRWGQG TLVTVSS |
| 4-53 | 2164 | EVQLVESGGGLVQPGGSLRLSCAASGRTFGDDTMGWFRQAPGKEREFVAAVSWS GSGVYYADSVKGRFTITADNSKNTAYLQMNSLKPENTAVYYCATDPPLFWGQGT LVTVSS |
| 4-54 | 2165 | EVQLVESGGGLVQPGGSLRLSCAASGRTFSDARMGWFRQAPGKEREFVGAVSWS GGTTVYADSVKGRFTISADNSKNTAYLQMNSLKPEDTAVYYCATTEDPYPRWGQ GTLVTVSS |
| 4-49 | 2166 | EVQLVESGGGLVQPGGSLRLSCAASGRTFGDYIMGWFRQAPGKERESVAAINWSA GYTAYADSVKGRFTISADNSKNTAYLQMNSLKPEDTAVYYCARASPNTGWHFDH WGQGTLVTVSS |
| 4-55 | 2167 | EVQLVESGGGLVQPGGSLRLSCAASGSGLSINAMGWFRQAPGKERESVAAISWSG GSTYTAYADSVKGRFTISADNSKNTAYLQMNSLKPEDTAVYYCAAYQAGWGDW GQGTLVTVSS |
| 4-39 | 2168 | EVQLVESGGGLVQPGGSLRLSCAASGRTFSNAAMGWFRQAPGKEREFVARILWT GASRNYADSVKGRFTISADNSKNTAYLQMNSLKPEDTAVYYCATTENPNPRWGQ GTLVTVSS |
| 4-56 | 2169 | EVQLVESGGGLVQPGGSLRLSCAASGFSLDYYGMGWFRQAPGKERESVAAISWN GDFTAYADSVKGRFTISADNSKNTAYLQMNSLKPEDTAVYYCAKRANPTGAYFD YWGQGTLVTVSS |
| 4-33 | 2170 | EVQLVESGGGLVQPGGSLRLSCAASGFTFSRHDMGWFRQAPGKEREFVAGINWES GSTNYADSVKGRFTISADNSKNTAYLQMNSLKPEDTAVYYCAADRGVYGGRWY RTSQYTWGQGTLVTVSS |

TABLE 38-continued

| Reformatted ACE2 Variant Sequences | | |
|---|---|---|
| Name | SEQ ID NO | Amino Acid Sequence |
| 4-57 | 2171 | EVQLVESGGGLVQPGGSLRLSCAASGLTFRNYAMGWFRQAPGKEREFVAAIGSGGYTDYADSVKGRFTISADNSKNTAYLQMNSLKPEDTAVYYCAVKPGWVARDPSQYNWGQGTLVTVSS |
| 4-25 | 2172 | EVQLVESGGGLVQPGGSLRLSCAASGGTFSRYAMGWFRQAPGKEREWVSAVDSGGSTYYADSVKGRFTISADNSKNTAYLQMNSLKPEDTAVYYCAASPSLRSAWQWGQGTLVTVSS |
| 4-58 | 2173 | EVQLVESGGGLVQPGGSLRLSCAASGFTLDYYDMGWFRQAPGKEREFVAAVTWSGGSTYYADSVKGRFTISADNSKNTAYLQMNSLKPEDTAVYYCAADRRGLASTRAADYDWGQGTLVTVSS |
| 4-59 | 2174 | EVQLVESGGGLVQPGGSLRLSCAASGRTFGDYIMGWFRQAPGKEREFVAAINWSAGYTPYADSVKGRFTISADNSKNTAYLQMNSLKPEDTAVYYCATAPPLFCWHFDLWGQGTLVTVSS |
| 4-6 | 2175 | EVQLVESGGGLVQPGGSLRLSCAASGRTFGDDIMGWFRQAPGKEREFVAAIHWSAGYTRYADSVKGRFTISADNSKNTAYLQMNSLKPEDTAVYYCATDPPLFWGHVDLWGQGTLVTVSS |
| 4-61 | 2176 | EVQLVESGGGLVQPGGSLRLSCAASGRTFGDYIMGWFRQAPGKEREIVAAINWSADYTPYADSVKGRFTISADNSKNTAYLQMNSLKPEDTAVYYCATAPPNTGWHFDHWGQGTLVTVSS |
| 4-3 | 2177 | EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATATPNTGWHFDHWGQGTLVTVSS |
| 4-62 | 2178 | EVQLVESGGGLVQPGGSLRLSCAASGRTFSDDTMGWFRQAPGKEREFVAAINWSGGSTDYADSVKGRFTISADNSKNTAYLQMNSLKPEDTAVYYCATDPPLFWGQGTLVTVSS |
| 4-43 | 2179 | EVQLVESGGGLVQPGGSLRLSCAASGRTFGDDTMGWFRQAPGKEREFVAGINWSGGNTYYADSVKGRFTISADNSKNTAYLQMNSLKPEDTAVYYCATDPPLFWGQGTLVTVSS |
| 4-5 | 2180 | EVQLVESGGGLVQPGGSLRLSCAASGRTFGDYIMGWFRQAPGKEREFVAAINWTGGYTSYADSVKGRFTISADNSKNTAYLQMNSLKPEDTAVYYCATDPPLFWGQGTLVTVSS |
| 4-42 | 2181 | EVQLVESGGGLVQPGGSLRLSCAASGRTFGDDTMGWFRQAPGKERECVAAINWSGGNTYYADSVKGRFTISADNSKNTAYLQMNSLKPEDTAVYYCATDPPLFWGQGTLVTVSS |
| 4-63 | 2182 | EVQLVESGGGLVQPGGSLRLSCAASGRTFSDYTMGWFRQAPGKEREFVAAINWSGGYTYYADSVKGRFTISADNSKNTAYLQMNSLKPEDTAVYYCATDPPLFWGQGTLVTVSS |
| 4-6 | 2183 | EVQLVESGGGLVQPGGSLRLSCAASGRTFGDYGMGWFRQAPGKEREFVATINWSGALTHYADSVKGRFTISADNSKNTAYLQMNSLKPEDTAVYYCATLPFYDFWSGYYTGYYYMDVWGQGTLVTVSS |
| 4-40 | 2184 | EVQLVESGGGLVQPGGSLRLSCAASGRTFSDDTMGWFRQAPGKEREFLAGVTWSGSSTFYADSVKGRFTISADNSKNTAYLQMNSLKPEDTAVYYCATDPPLFWGQGTLVTVSS |
| 4-21 | 2185 | EVQLVESGGGLVQPGGSLRLSCAASGRTFSDDIMGWFRQAPGKEREFVAAISWSGGNTHYADSVKGRFTISADNSKNTAYLQMNSLKPEDTAVYYCATDPPLFWGQGTLVTVSS |
| 4-64 | 2186 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCATASPNTGWHFDHWGQGTLVTVSS |
| 4-47 | 2187 | EVQLVESGGGLVQPGGSLRLSCAASGFTFDDDYVMGWFRQAPGKEREFVAAVSGSGDDTYYADSVKGRFTISADNSKNTAYLQMNSLKPEDTAVYYCAADRRGLASTRAADYDWGQGTLVTVSS |
| 4-65 | 2188 | EVQLVESGGGLVQPGGSLRLSCAASGRTFGDYIMGWFRQAPGKEREFVAAINWSAGYTAYADSVKGRFTISADNSKNTAYLQMNSLKPEDTAVYYCATEPPLSCWHFDLWGQGTLVTVSS |

TABLE 38-continued

Reformatted ACE2 Variant Sequences

| Name | SEQ ID NO | Amino Acid Sequence |
|---|---|---|
| 4-18 | 2189 | EVQLVESGGGLVQPGGSLRLSCAASGRTFGDYIMGWFRQAPGKEREIVAAINWSGGYTPYADSVKGRFTISADNSKNTAYLQMNSLKPEDTAVYYCATAPPNTGWHFDHWGQGTLVTVSS |
| 4-66 | 2190 | EVQLVESGGGLVQPGGSLRLSCAASGRTFGDDTMGWFRQAPGKEREIVAAINWSAGYTPYADSVKGRFTISADNSKNTAYLQMNSLKPEDTAVYYCATDPPLFCCHFDLWGQGTLVTVSS |
| 4-36 | 2191 | EVQLVESGGGLVQPGGSLRLSCAASGRTFSDDTMGWFRQAPGKEREFVAAISWSGGTTRYADSVKGRFTISADNSKNTAYLQMNSLKPEDTAVYYCATDPPLFWGQGTLVTVSS |
| 4-67 | 2192 | EVQLVESGGGLVQPGGSLRLSCAASGRTFSDDTMGWFRQAPGKEREFVAAINWSGDSTYYADSVKGRFTISADNSKNTAYLQMNSLKPEDTAVYYCATDPPLFWGQGTLVTVSS |
| 4-16 | 2193 | EVQLVESGGGLVQPGGSLRLSCAASGRTFSDDTMGWFRQAPGKEREFVAAINWSGGTTRYADSVKGRFTISADNSKNTAYLQMNSLKPEDTAVYYCATDPPLFWGQGTLVTVSS |
| 4-11 | 2194 | EVQLVESGGGLVQPGGSLRLSCAASGRTFSDDAMGWFRQAPGKEREFVAAIHWSGSSTRYADSVKGRFTISADNSKNTAYLQMNSLKPEDTAVYYCATDPPLFWGQGTLVTVSS |
| 4-68 | 2195 | EVQLVESGGGLVQPGGSLRLSCAASGRTFSDDTMGWFRQAPGKERELVGTINWSGGSTYYADSVKGRFTISADNSKNTAYLQMNSLKPEDTAVYYCATDPPLFWGQGTLVTVSS |
| 4-34 | 2196 | EVQLVESGGGLVQPGGSLRLSCAASGRTFGDYIMGWFRQAPGKEREFVAAINWSGGYTPYADSVKGRFTISADNSKNTAYLQMNSLKPEDTAVYYCATDPPLFWGQGTLVTVSS |
| 4-28 | 2197 | EVQLVESGGGLVQPGGSLRLSCAASGRTFGDDTMGWFRQAPGKERELVAAINWNGGNTHYADSVKGRFTISADNSKNTAYLQMNSLKPEDTAVYYCATDPPLFWGQGTLVTVSS |
| 4-69 | 2198 | EVQLVESGGGLVQPGGSLRLSCAASGRTFSDDAMGWFRQAPGKEREFVAAINWSGGTTRYADSVKGRFTISADNSKNTAYLQMNSLKPEDTAVYYCATDPPLFWGQGTLVTVSS |
| 4-7 | 2199 | EVQLVESGGGLVQPGGSLRLSCAASGRTFGDYIMGWFRQAPGKERESVAAINWSAGYTPYADSVKGRFTISADNSKNTAYLQMNSLKPEDTAVYYCATDPPLFWGHVDLWGQGTLVTVSS |
| 4-71 | 2200 | EVQLVESGGGLVQPGGSLRLSCAASGRTFSDDTMGWFRQAPGKEREWVASINWSGGSTYYADSVKGRFTISADNSKNTAYLQMNSLKPEDTAVYYCATDPPLFWGQGTLVTVSS |
| 4-23 | 2201 | EVQLVESGGGLVQPGGSLRLSCAASGRTFSDDAMGWFRQAPGKEREFVAGISWNGGSIYYADSVKGRFTISADNSKNTAYLQMNSLKPEDTAVYYCATDPPLFWGQGTLVTVSS |
| 4-9 | 2202 | EVQLVESGGGLVQPGGSLRLSCAASGFTFDDYEMGWFRQAPGKEREFVAAISWRGGTTYYADSVKGRFTISADNSKNTAYLQMNSLKPEDTAVYYCAADRRGLASTRAGDYDWGQGTLVTVSS |
| 4-72 | 2203 | EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGHVDLWGQGTLVTVSS |
| 4-73 | 2204 | EVQLVESGGGLVQPGGSLRLSCAASGRTFSDDAMGWFRQAPGKEREFVAAINWSGGSTRYADSVKGRFTISADNSKNTAYLQMNSLKPEDTAVYYCATDPPLFWGQGTLVTVSS |
| 4-29 | 2205 | EVQLVESGGGLVQPGGSLRLSCAASGVTLDDYAMGWFRQAPGKEREFVAVINWSGGSTDYADSVKGRFTISADNSKNTAYLQMNSLKPEDTAVYYCARGGGWVPSSTSESLNWYFDRWGQGTLVTVSS |
| 4-41 | 2206 | EVQLVESGGGLVQPGGSLRLSCAASGRTFGDYIMGWFRQAPGKERESVAAINWSGGTTPYADSVKGRFTISADNSKNTAYLQMNSLKPEDTAVYYCATDPPLFCCHVDLWGQGTLVTVSS |

TABLE 38-continued

Reformatted ACE2 Variant Sequences

| Name | SEQ ID NO | Amino Acid Sequence |
|---|---|---|
| 4-74 | 2207 | EVQLVESGGGLVQPGGSLRLSCAASGLTFSDDTMGWFRQAPGKEREFVAAVSWS GGNTYYADSVKGRFTISADNSKNTAYLQMNSLKPEDTAVYYCATDPPLFWGQGT LVTVSS |
| 4-75 | 2208 | EVQLVESGGGLVQPGGSLRLSCAASGRTFGDDTMGWFRQAPGKEREFVAAINWT GGYTPYADSVKGRFTISADNSKNTAYLQMNSLKPEDTAVYYCATDPPLFWGQGT LVTVSS |
| 4-31 | 2209 | EVQLVESGGGLVQPGGSLRLSCAASGRTFGDYIMGWFRQAPGKEREFVATINWTA GYTYYADSVKGRFTISADNSKNTAYLQMNSLKPEDTAVYYCATDPPLFCWHFDH WGQGTLVTVSS |
| 4-32 | 2210 | EVQLVESGGGLVQPGGSLRLSCAASGRTFGDDTMGWFRQAPGKEREFVAAINWS GGNTDYADSVKGRFTISADNSKNTAYLQMNSLKPEDTAVYYCATDPPLFWGQGT LVTVSS |
| 4-15 | 2211 | EVQLVESGGGLVQPGGSLRLSCAASGRTFGDYTMGWFRQAPGKEREFVAAINWS GGNTYYADSVKGRFTISADNSKNTAYLQMNSLKPEDTAVYYCATDPPLFWGQGT LVTVSS |
| 4-14 | 2212 | EVQLVESGGGLVQPGGSLRLSCAASGRTFSDDTMGWFRQAPGKEREFVAGINWS GNGVYYADSVKGRFTISADNSKNTAYLQMNSLKPEDTAVYYCATDPPLFWGQGT LVTVSS |
| 4-76 | 2213 | EVQLVESGGGLVQPGGSLRLSCAASGRTFGDYAMGWFRQAPGKERELVAPINWS GGSTYYADSVKGRFTISADNSKNTAYLQMNSLKPEDTAVYYCATDPPLFWGQGT LVTVSS |
| 4-50 | 2214 | EVQLVESGGGLVQPGGSLRLSCAASGGTFSNSGMGWFRQAPGKERELVAVVNWS GRRTYYADSVKGRFTISADNSKNTAYLQMNSLKPEDTAVYYCAVPWMDYNRRD WGQGTLVTVSS |
| 4-17 | 2215 | EVQLVESGGGLVQPGGSLRLSCAASGQLANFASYAMGWFRQAPGKEREFVAAIT RSGSSTVYADSVKGRFTISADNSKNTAYLQMNSLKPEDTAVYYCATTMNPNPRW GQGTLVTVSS |
| 4-37 | 2216 | EVQLVESGGGLVQPGGSLRLSCAASGRTFSDDIMGWFRQAPGKEREFVAAINWTG GSTYYADSVKGRFTISADNSKNTAYLQMNSLKPEDTAVYYCATDPPLFWGQGTL VTVSS |
| 4-44 | 2217 | EVQLVESGGGLVQPGGSLRLSCAASGRTFGDYIMGWFRQAPGKEREIVAAINWSA GYTAYADSVKGRFTISADNSKNTAYLQMNSLKPEDTAVYYCATARPNTGWHFDH WGQGTLVTVSS |
| 4-77 | 2218 | EVQLVESGGGLVQPGGSLRLSCAASGRTFSDDTMGWFRQAPGKEREWVGSINWS GGSTYYADSVKGRFTISADNS KNTAYLQMNSLKPEDTAVYYCATDPPLFWGQGT LVTVSS |
| 4-78 | 2219 | EVQLVESGGGLVQPGGSLRLSCAASGRTFSDDTMGWFRQAPGKEREFVAGMTWS GSSTFYADSVKGRFTISADNSKNTAYLQMNSLKPEDTAVYYCATDPPLFWGQGTL VTVSS |
| 4-79 | 2220 | EVQLVESGGGLVQPGGSLRLSCAASGRTFGDYIMGWFRQAPGKERECVAAINWS GDYTDYADSVKGRFTISADNSKNTAYLQMNSLKPED TAVYYCATDPPLFWGQGT LVTVSS |
| 4-8 | 2221 | EVQLVESGGGLVQPGGSLRLSCAASGRTFGDYIMGWFRQAPGKEREFVGGINWSG GYTYYADSVKGRFTISADNSKNTAYLQMNSLKPEDTAVYYCATDPPLFWGQGTL VTVSS |
| 4-81 | 2222 | EVQLVESGGGLVQPGGSLRLSCAASGRTFSDDTMGWFRQAPGKEREFVAAVNWS GGSTYYADSVKGRFTISADNSKNTAYLQMNSLKPEDTAVYYCATDPPLFWGQGT LVTVSS |
| 4-82 | 2223 | EVQLVESGGGLVQPGGSLRLSCAASGRTFGDYAMGWFRQAPGKEREFVAAINWS GGYTRYADSVKGRFTISADNSKNTAYLQMNSLKPEDTAVYYCATDPPLFWGQGT LVTVSS |
| 4-83 | 2224 | EVQLVESGGGLVQPGGSLRLSCAASGRTFGDDTMGWFRQAPGKEREFVAAINWS GGYTPYADSVKGRFTISADNSKNTAYLQMNSLKPEDTAVYYCATDPPLFWGQGT LVTVSS |

TABLE 38-continued

Reformatted ACE2 Variant Sequences

| Name | SEQ ID NO | Amino Acid Sequence |
|---|---|---|
| 4-35 | 2225 | EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDRWGQGTLVTVSS |
| 4-45 | 2226 | EVQLVESGGGLVQPGGSLRLSCAASGRTFGDYIMGWFRQAPGKEREFVAAINWSGGYTHYADSVKGRFTISADNSKNTAYLQMNSLKPEDTAVYYCATDPPLFWGQGTLVTVSS |
| 4-84 | 2227 | EVQLVESGGGLVQPGGSLRLSCAASGRTFSDDTMGWFRQAPGKEREFVAAITWSGGRTRYADSVKGRFTISADNSKNTAYLQMNSLKPEDTAVYYCATDRPLFWGQGTLVTVSS |
| 4-85 | 2228 | EVQLVESGGGLVQPGGSLRLSCAASGRTFGDYIMGWFRQAPGKERESVAAINWSGGYTAYADSVKGRFTISADNSKNTAYLQMNSLKPEDTAVYYCATASPNTGWHFDHWGQGTLVTVSS |
| 4-86 | 2229 | EVQLVESGGGLVQPGGSLRLSCAASGRTFSDDTMGWFRQAPGKEREFVAAIHWSGSSTRYADSVKGRFTISADNSKNTAYLQMNSLKPEDTAVYYCATDPPLFWGQGTLVTVSS |
| 4-87 | 2230 | EVQLVESGGGLVQPGGSLRLSCAASGRTFSDYTMGWFRQAPGKEREWVAAINWSGGTTYYADSVKGRFTISADNSKNTAYLQMNSLKPEDTAVYYCATDPPLFWGQGTLVTVSS |
| 4-88 | 2231 | EVQLVESGGGLVQPGGSLRLSCAASGRTFGDDTMGWFRQAPGKEREFVAAINWSGDNTHYADSVKGRFTISADNSKNTAYLQMNSLKPEDTAVYYCATDPPLFWGQGTLVTVSS |
| 4-89 | 2232 | EVQLVESGGGLVQPGGSLRLSCAASGFAFGDNWIGWFRQAPGKEREWVASISSGGTTAYADNVKGRFTIIADNSKNTAYLQMNSLKPEDTAVYYCAHRGGWLRPWGYWGQGTLVTVSS |
| 4-9 | 2233 | EVQLVESGGGLVQPGGSLRLSCAASGRTFSDDAMGWFRQAPGKEREFVGRINWSGGNTYYADSVKGRFTISADNSKNTAYLQMNSLKPED TAVYYCATDPPLFWGQGTLVTVSS |
| 4-91 | 2234 | EVQLVESGGGLVQPGGSLRLSCAASGRTFSDDTMGWFRQAPGKEREFVGGISWSGGNTYYADSVKGRFTISADNSKNTAYLQMNSLKPEDTAVYYCATDPPLFWGQGTLVTVSS |
| 4-92 | 2235 | EVQLVESGGGLVQPGGSLRLSCAASGRTFSDDTMGWFRQAPGKEREFVAAINWSGGSTYYADSVKGRFTISADNSKNTAYLQMNSLKPEDTAVYYCATDPPLFWGQGTLVTVSS |
| 4-46 | 2236 | EVQLVESGGGLVQPGGSLRLSCAASGRTFGDDTMGWFRQAPGKEREFVAAINWSGGYTYYADSVKGRFTISADNSKNTAYLQMNSLKPEDTAVYYCATDPPLFWGQGTVLVTVSS |
| 4-20 | 2237 | EVQLVESGGGLVQPGGSLRLSCAASGRTFGDYIMGWFRQAPGKEREFVAAINWSADYTAYADSVKGRFTISADNSKNTAYLQMNSLKPEDTAVYYCATDPPLFCWHFDHVWGQGTLVTVSS |
| 4-93 | 2238 | EVQLVESGGGLVQPGGSLRLSCAASGRTFSDDAMGWFRQAPGKEREFVAAINWSGSSTYYADSVKGRFTISADNSKNTAYLQMNSLKPEDTAVYYCATDPPLFWGQGTLVTVSS |
| 4-4 | 2239 | EVQLVESGGGLVQPGGSLRLSCAASGRTFGDYIMGWFRQAPGKEREMVAAINWIAGYTADADSVRRLFTITADNNKNTAHLMMNLLKPENTAVYYCAEPSPNTGWHFDVHWGQGTLVTVSS |
| 4-2 | 2240 | EVQLVESGGGLVQPGGSLRLSCAASGRTFGDDTMGWFRQAPGKEREFVAAINWSGGNTPYADSVKGRFTISADNSKNTAYLQMNSLKPEDTAVYYCATDPPLFWGQGTLVTVSS |
| 4-94 | 2241 | EVQLVESGGGLVQPGGSLRLSCAASGRTFSDDTMGWFRQAPGKEREFVAAINWSGDNTHYADSVKGRFTISADNSKNTAYLQMNSLKPEDTAVYYCATDPPLFWGQGTLVTVSS |
| 4-95 | 2242 | EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATAPPLFCWHFDHWGQGTLVTVSS |

TABLE 38-continued

Reformatted ACE2 Variant Sequences

| Name | SEQ ID NO | Amino Acid Sequence |
|---|---|---|
| 4-12 | 2243 | EVQLVESGGGLVQPGGSLRLSCAASGFTFGDYVMGWFRQAPGKEREIVAAINWN AGYTAYADSVRGLFTITADNSKNTAYLQMNSLKPEDTAVYYCAKASPNTGWHFD HWGQGTLVTVSS |
| 4-30 | 2244 | E TABLE 38-continued Reformatted ACE2 Variant Sequences

| Name | SEQ ID NO | Amino Acid Sequence |
|---|---|---|
| 4-11 | 2261 | EVQLVESGGGLVQPGGSLRLSCAASGNIAAINVMGWFRQAPGKEREFVAAISASG RRTDYADSVKGRFTISADNSKNTAYLQMNSLKPEDTAVYYCARRVYYYDSSGPP GVTFDIWGQGTLVTVSS |
| 4-111 | 2262 | EVQLVESGGGLVQPGGSLRLSCAASGIITSRYVMGWFRQAPGKEREGVAAISTGGS TIYADSVKGRFTISADNSKNTAYLQMNSLKPEDTAVYYCARQDSSSPYFDYWGQG TLVTVSS |
| 4-112 | 2263 | EVQLVESGGGLVQPGGSLRLSCAASGFSFDDDYVMGWFRQAPGKEREFVAAISNS GLSTYYADSVKGRFTISADNSKNTAYLQMNSLKPEDTAVYYCAADRRGLASTRA ADYDWGQGTLVTVSS |
| 4-113 | 2264 | EVQLVESGGGLVQPGGSLRLSCAASGSISSINVMGWFRQAPGKEREFVATMRWST GSTYYADSVKGRFTISADNSKNTAYLQMNSLKPEDTAVYYCAQRVRGFFGPLRTT PSWYEWGQGTLVTVSS |
| 4-114 | 2265 | EVQLVESGGGLVQPGGSLRLSCAASGLTFILYRMGWFRQAPGKEREFVAAINNFG TTKYADSVKGRFTISADNSKNTAYLQMNSLKPEDTAVYYCARTHYDFWSGYTSR TPNYFDYWGQGTLVTVSS |
| 4-115 | 2266 | EVQLVESGGGLVQPGGSLRLSCAASGGTFSVYHMGWFRQAPGKEREPVAAISWS GGSTAYADSVKGRFTISADNSKNTAYLQMNSLKPEDTAVYYCAAVNTWTSPSFDS WGQGTLVTVSS |
| 4-116 | 2267 | EVQLVESGGGLVQPGGSLRLSCAASGRAFSTYGMGWFRQAPGKEREFVAGINWS GDTPYYADSVKGRFTISADNSKNTAYLQMNSLKPEDTAVYYCAREVGPPPGYFDL WGQGTLVTVSS |
| 4-117 | 2268 | EVQLVESGGGLVQPGGSLRLSCAASGRTFSDIAMGWFRQAPGKEREFVASINWGG GNTYYADSVKGRFTISADNSKNTAYLQMNSLKPEDTAVYYCAAKGIWDYLGRRD FGDWGQGTLVTVSS |
| 4-118 | 2269 | EVQLVESGGGLVQPGGSLRLSCAASGRTFSSARMGWFRQAPGKEREFVAAISWSG DNTHYADSVKGRFTISADNSKNTAYLQMNSLKPEDTAVYYCATTENPNPRWGQG TLVTVSS |
| 4-119 | 2270 | EVQLVESGGGLVQPGGSLRLSCAASGFAFSSYAMGWFRQAPGKEREWVATINGD DYTYYADSVKGRFTISADNSKNTAYLQMNSLKPEDTAVYYCVATPGGYGLWGQ GTLVTVSS |
| 4-12 | 2271 | EVQLVESGGGLVQPGGSLRLSCAASGITFRRHDMGWFRQAPGKEREFVAAIRWSS SSTVYADSVKGRFTISADNSKNTAYLQMNSLKPEDTAVYYCAADRGVYGGRWYR TSQYTWGQGTLVTVSS |
| 4-121 | 2272 | EVQLVESGGGLVQPGGSLRLSCAASGTAASFNPMGWFRQAPGKEREFVAAITSGG STNYADSVKGRFTISADNSKNTAYLQMNSLKPEDTAVYYCAAIAYEEGVYRWDW GQGTLVTVSS |
| 4-122 | 2273 | EVQLVESGGGLVQPGGSLRLSCAASGNINIINYMGWFRQAPGKEREGVAAIHWNG DSTAYADSVKGRFTISADNSKNTAYLQMNSLKPEDTAVYYCASGPPYSNYFAYW GQGTLVTVSS |
| 4-123 | 2274 | EVQLVESGGGLVQPGGSLRLSCAASGFTFDDYAMGWFRQAPGKERESVAAISGSG GSTAYADSVKGRFTISADNSKNTAYLQMNSLKPEDTAVYYCAKIMGSGRPYFDH WGQGTLVTVSS |
| 4-124 | 2275 | EVQLVESGGGLVQPGGSLRLSCAASGNIFTRNVMGWFRQAPGKEREFVAAITSSG STNYADSVKGRFTISADNSKNTAYLQMNSLKPEDTAVYYCARPSSDLQGGVDYW GQGTLVTVSS |
| 4-125 | 2276 | EVQLVESGGGLVQPGGSLRLSCAASGRTFSSIAMGWFRQAPGKEREFVASINWGG GNTIYADSVKGRFTISADNSKNTAYLQMNSLKPEDTAVYYCAAKGIWDYLGRRD FGDWGQGTLVTVSS |
| 4-126 | 2277 | EVQLVESGGGLVQPGGSLRLSCAASGIPSTLRAMGWFRQAPGKEREFVAAVSSLG PFTRYADSVKGRFTISADNSKNTAYLQMNSLKPEDTAVYYCAAKPGWVARDPSE YNWGQGTLVTVSS |
| 4-127 | 2278 | EVQLVESGGGLVQPGGSLRLSCAASGFTLDDSAMGWFRQAPGKEREWVAAITNG GSTYYADSVKGRFTISADNSKNTAYLQMNSLKPEDTAVYYCARFARGSPYFDFW GQGTLVTVSS |

TABLE 38-continued

Reformatted ACE2 Variant Sequences

| Name | SEQ ID NO | Amino Acid Sequence |
|---|---|---|
| 4-128 | 2279 | EVQLVESGGGLVQPGGSLRLSCAASGSISSFNAMGWFRQAPGKERESVAAIDWDG STAYADSVKGRFTISADNSKNTAYLQMNSLKPEDTAVYYCARGGGYYGSGSFEY WGQGTLVTVSS |
| 4-129 | 2280 | EVQLVESGGGLVQPGGSLRLSCAASGNIFSDNIIGWFRQAPGKEREMVAYYTSGGS IDYADSVKGRFTISADNSKNTAYLQMNSLKPEDTAVYYCARGTAVGRPPPGGMD VWGQGTLVTVSS |
| 4-13 | 2281 | EVQLVESGGGLVQPGGSLRLSCAASGSISSIGAMGWFRQAPGKEREGVAAISSSGS STVYADSVKGRFTISADNSKNTAYLQMNSLKPEDTAVYYCARVPPGQAYFDSWG QGTLVTVSS |
| 4-131 | 2282 | EVQLVESGGGLVQPGGSLRLSCAASGFTFDDYGMGWFRQAPGKERELVATITWS GDSTYYADSVKGRFTISADNSKNTAYLQMNSLKPEDTAVYYCAKGGSWYYDSSG YYGRWGQGTLVTVSS |
| 4-132 | 2283 | EVQLVESGGGLVQPGGSLRLSCAASGRTFSNYTMGWFRQAPGKEREWVSAISWS TGSTYYADSVKGRFTISADNSKNTAYLQMNSLKPEDTAVYYCAADRYGPPWYD WGQGTLVTVSS |
| 4-134 | 2284 | EVQLVESGGGLVQPGGSLRLSCAASGGTFSSVGMGWFRQAPGKERELVAVINWS GARTYYADSVKGRFTISADNSKNTAYLQMNSLKPEDTAVYYCAVPWMDYNRRD WGQGTLVTVSS |
| 4-135 | 2285 | EVQLVESGGGLVQPGGSLRLSCAASGRIFTNTAMGWFRQAPGKEREGVAAINWS GGSTAYADSVKGRFTISADNSKNTAYLQMNSLKPEDTAVYYCARTSGSYSFDYW GQGTLVTVSS |
| 4-136 | 2286 | EVQLVESGGGLVQPGGSLRLSCAASGEEFSDHWMGWFRQAPGKEREFVGAIHWS GGRTYYADSVKGRFTISADNSKNTAYLQMNSLKPEDTAVYYCAADRRGLASTRA ADYDWGQGTLVTVSS |
| 4-137 | 2287 | EVQLVESGGGLVQPGGSLRLSCAASGRTFSSIAMGWFRQAPGKEREFVAAINWSG ARTAYADSVKGRFTISADNSKNTAYLQMNSLKPEDTAVYYCAAKGIWDYLGRRD FGDWGQGTLVTVSS |
| 4-138 | 2288 | EVQLVESGGGLVQPGGSLRLSCAASGSTSSLRTMGWFRQAPGKEREGVAAISSRD GSTIYADSVKGRFTISADNSKNTAYLQMNSLKPEDTAVYYCARDDSSSPYFDYWG QGTLVTVSS |
| 4-139 | 2289 | EVQLVESGGGLVQPGGSLRLSCAASGGGTFGSYAMGWFRQAPGKEREFVAAISIA SGASGGTTNYADSVKGRFTISADNSKNTAYLQMNSLKPEDTAVYYCATTMNPNP RWGQGTLVTVSS |
| 4-14 | 2290 | EVQLVESGGGLVQPGGSLRLSCAASGRTFSNAAMGWFRQAPGKEREFVARITWN GGSTFYADSVKGRFTISADNSKNTAYLQMNSLKPEDTAVYYCATTENPNPRWGQ GTLVTVSS |
| 4-141 | 2291 | EVQLVESGGGLVQPGGSLRLSCAASGIILSDNAMGWFRQAPGKEREFVAAISWLG ESTYYADSVKGRFTISADNSKNTAYLQMNSLKPEDTAVYYCAADRRGLASTRAA DYDWGQGTLVTVSS |
| 4-142 | 2292 | EVQLVESGGGLVQPGGSLRLSCAASGRTFGDYIMGWFRQAPGKERESVAAINWN GGYTAYADSVKGRFTISADNSKNTAYLQMNSLKPEDTAVYYCATTSPNTGWHYY RWGQGTLVTVSS |
| 4-143 | 2293 | EVQLVESGGGLVQPGGSLRLSCAASGFNFNWYPMGWFRQAPGKERESVAAISWT GVSTYTAYADSVKGRFTISADNSKNTAYLQMNSLKPEDTAVYYCARWGPGPAGG SPGLVGFDYWGQGTLVTVSS |
| 4-144 | 2294 | EVQLVESGGGLVQPGGSLRLSCAASGSIRSVSVMGWFRQAPGKEREAVAAISWSG VGTAYADSVKGRFTISADNSKNTAYLQMNSLKPEDTAVYYCAAYQRGWGDWGQ GTLVTVSS |
| 4-145 | 2295 | EVQLVESGGGLVQPGGSLRLSCAASGMTFRLYAMGWFRQAPGKEREFVGAINWL SESTYYADSVKGRFTISADNSKNTAYLQMNSLKPEDTAVYYCAAKPGWVARDPS EYNWGQGTLVTVSS |
| 4-146 | 2296 | EVQLVESGGGLVQPGGSLRLSCAASGRTFSDDAMGWFRQAPGKEREFVAAINWS GGSTYYADSVKGRFTISADNSKNTAYLQMNSLKPEDTAVYYCATDPPLFWGQGT MVTVSS |

TABLE 38-continued

Reformatted ACE2 Variant Sequences

| Name | SEQ ID NO | Amino Acid Sequence |
|---|---|---|
| 4-147 | 2297 | EVQLVESGGGLVQPGGSLRLSCAASGGTFSVYAMGWFRQAPGKEREGVAAISMS GDDAAYADSVKGRFTISADNSKNTAYLQMNSLKPEDTAVYYCAKISKDDGGKPR GAFFDSWGQGTLVTVSS |
| 4-148 | 2298 | EVQLVESGGGLVQPGGSLRLSCAASGFALGYYAMGWFRQAPGKERESVAAISSRD GSTAYADSVKGRFTISADNSKNTAYLQMNSLKPEDTAVYYCARLATGPQAYFHH WGQGTLVTVSS |
| 4-149 | 2299 | EVQLVESGGGLVQPGGSLRLSCAASGFNLDDYAMGWFRQAPGKERESVAAISWD GGATAYADSVKGRFTISADNSKNTAYLQMNSLKPEDTAVYYCARVGRGTTAFDS WGQGTLVTVSS |
| 4-15 | 2300 | EVQLVESGGGLVQPGGSLRLSCAASGNTFSGGFMGWFRQAPGKEREFVASIRSGA RTYYADSVKGRFTISADNSKNTAYLQMNSLKPEDTAVYYCAQRVRGFFGPLRTTP SWYEWGQGTLVTVSS |
| 4-151 | 2301 | EVQLVESGGGLVQPGGSLRLSCAASGSIRSINIMGWFRQAPGKEREAVAAISWSGG STVYADSVKGRFTISADNSKNTAYLQMNSLKPEDTAVYYCASLLAGDRYFDYWG QGTLVTVSS |

TABLE 39

SARS-CoV-2 Variant Variable Heavy Chain Sequences

| | | |
|---|---|---|
| 7-1 | 2302 | EVQLVESGGGLVQPGGSLRLSCAASGFTLGDYVMGWFRQAPGKEREFVAAIHSG GSTYADSVKGRFTISADNSKNTAYLQMNSLKPEDTAVYYCAAKEYGGTRRYDRA YNWGQGTLVTVSS |
| 7-2 | 2303 | EVQLVESGGGLVQPGGSLRLSCAASGGGTFGSYAMGWFRQAPGKERELVAAISSG GSTNYADSVKGRFTISADNSKNTAYLQMNSLKPEDTAVYYCARGDWRYGWGQG TLVTVSS |
| 7-3 | 2304 | EVQLVESGGGLVQPGGSLRLSCAASGRTYSISAMGWFRQAPGKEREFVAAISMSG DDSAYADSVKGRFTISADNSKNTAYLQMNSLKPEDTAVYYCAAQLGYESGYSLT YDYDWGQGTLVTVSS |
| 7-4 | 2305 | EVQLVESGGGLVQPGGSLRLSCAASGGTFSTYPMGWFRQAPGKEREFVAAITSDG STLYADSVKGRFTISADNSKNTAYLQMNSLKPEDTAVYYCAATDYNKAYAREGR RYDWGQGTLVTVSS |
| 7-5 | 2306 | EVQLVESGGGLVQPGGSLRLSCAASGSIFRINAMGWFRQAPGKEREFVAAIHWSG SSTRYADSVKGRFTISADNSKNTAYLQMNSLKPEDTAVYYCAAQDRRRGDYYTF DYHWGQGTLVTVSS |
| 7-6 | 2307 | EVQLVESGGGLVQPGGSLRLSCAASGGTFNNYAMGWFRQAPGKERELVAAITSG GSTDYADSVKGRFTISADNSKNTAYLQMNSLKPEDTAVYYCARGDWRYGWGQG TLVTVSS |
| 7-7 | 2308 | EVQLVESGGGLVQPGGSLRLSCAASGTIVNINVMGWFRQAPGKEREFVAAIHWSG GLKAYADSVKGRFTISADNSKNTAYLQMNSLKPEDTAVYYCAMNRAGIYEWGQ GTLVTVSS |
| 7-8 | 2309 | EVQLVESGGGLVQPGGSLRLSCAASGSTFSNYAMGWFRQAPGKERELVAAITSGG STSYADSVKGRFTISADNSKNTAYLQMNSLKPEDTAVYYCARGDWRYGWGQGT LVTVSS |
| 7-9 | 2310 | EVQLVESGGGLVQPGGSLRLSCAASGFSFDDYVMGWFRQAPGKEREFVAAISRSG NLKSYADSVKGRFTISADNSKNTAYLQMNSLKPEDTAVYYCAAKEYGGTRRYDR AYNWGQGTLVTVSS |
| 7-10 | 2311 | EVQLVESGGGLVQPGGSLRLSCAASGSAFRSTVMGWFRQAPGKEREFVAAVIGSS GITDYADSVKGRFTISADNSKNTAYLQMNSLKPEDTAVYYCARGDWRYGWGQG TLVTVSS |
| 7-11 | 2312 | EVQLVESGGGLVQPGGSLRLSCAASGRTFSDAMGWFRQAPGKEREFVAAISRSG NLKAYADSVKGRFTISADNSKNTAYLQMNSLKPEDTAVYYCAVQVNGTWAWGQ GTLVTVSS |

TABLE 39-continued

SARS-CoV-2 Variant Variable Heavy Chain Sequences 7-12 2313 EVQLVESGGGLVQPGGSLRLSCAASGFTLDYYAMGWFRQAPGKERELVAAISWN
GGSTSYADSVKGRFTISADNSKNTAYLQMNSLKPEDTAVYYCARGDWRYGWGQ
GTLVTVSS 7-13 2314 EVQLVESGGGLVQPGGSLRLSCAASGGTFSTYVMGWFRQAPGKEREFVAAISWSG
ESTLYADSVKGRFTISADNSKNTAYLQMNSLKPEDTAVYYCAADLMYGVDRRYD
WGQGTLVTVSS 7-14 2315 EVQLVESGGGLVQPGGSLRLSCAASGISSSKRNMGWFRQAPGKEREFVAGISWTG
GITYYADSVKGRFTISADNSKNTAYLQMNSLKPEDTAVYYCAIAGRGRWGQGTL
VTVSS 7-15 2316 EVQLVESGGGLVQPGGSLRLSCAASGRRFSAYGMGWFRQAPGKEREFVAVISRSG
TLTRYADSVKGRFTISADNSKNTAYLQMNSLKPEDTAVYYCASSGPADARNGER
WHWGQGTLVTVSS 7-16 2317 EVQLVESGGGLVQPGGSLRLSCAASGLTFSSFVMGWFRQAPGKEREFVAAISSNG
GSTRYADSVKGRFTISADNSKNTAYLQMNSLKPEDTAVYYCAAKEYGGTRRYDR
AYNWGQGTLVTVSS 7-17 2318 EVQLVESGGGLVQPGGSLRLSCAASGTVFSISAMGWFRQAPGKEREFVAAISMSG
DDTAYADSVKGRFTISADNSKNTAYLQMNSLKPEDTAVYYCAAQLGYESGYSLT
YDYDWGQGTLVTVSS 7-18 2319 EVQLVESGGGLVQPGGSLRLSCAASGSIFSPNVMGWFRQAPGKEREFVAAITNGG
STKYADSVKGRFTISADNSKNTAYLQMNSLKPEDTAVYYCAAQRWRGGSYEWG
QGTLVTVSS 7-19 2320 EVQLVESGGGLVQPGGSLRLSCAASGIPASIRVMGWFRQAPGKEREFVAAIHWSG
SSTRYADSVKGRFTISADNSKNTAYLQMNSLKPEDTAVYYCALSRAIVPGDSEYD
YRWGQGTLVTVSS 7-20 2321 EVQLVESGGGLVQPGGSLRLSCAASGRTFSMSAMGWFRQAPGKEREFVSAISWSG
GSTLYADSVKGRFTISADNSKNTAYLQMNSLKPEDTAVYYCAAQLGYESGYSLTY
DYDWGQGTLVTVSS 7-21 2322 EVQLVESGGGLVQPGGSLRLSCAASGRTFSNYAMGWFRQAPGKERELVAAITSGG
STDYADSVKGRFTISADNSKNTAYLQMNSLKPEDTAVYYCARGDWRYGWGQGT
LVTVSS 7-22 2323 EVQLVESGGGLVQPGGSLRLSCAASGRTFSSYAMGWFRQAPGKERELVAAISTGG
STYYADSVKGRFTISADNSKNTAYLQMNSLKPEDTAVYYCARGDWRYGWGQGT
LVTVSS 7-23 2324 EVQLVESGGGLVQPGGSLRLSCAASGRSFSSVGMGWFRQAPGKEREFVAVISRSG
ASTAYADSVKGRFTISADNSKNTAYLQMNSLKPEDTAVYYCASAGPADARNGER
WAWGQGTLVTVSS 7-24 2325 EVQLVESGGGLVQPGGSLRLSCAASGRAFRRYTMGWFRQAPGKERELIAVINWSG
DRRYADSVKGRFTISADNSKNTAYLQMNSLKPEDTAVYYCAATLAKGGGRWG
QGTLVTVSS 7-25 2326 EVQLVESGGGLVQPGGSLRLSCAAMAWAGFARRRAKNAKWWRALPRGGPTYA
DSVKGRFTISADNSKNTAYLQMNSLKPEDTAVYYCAAGGMWYGSSLYVRFDLLE
DGMDWGQGTLVTVSS 7-26 2327 EVQLVESGGGLVQPGGSLRLSCAASGSISSINGMGWFRQAPGKERELVALISRSGG
TTYYADSVKGRFTISADNSKNTAYLQMNSLKPEDTAVYYCASAGPADARNGERW
AWGQGTLVTVSS 7-27 2328 EVQLVESGGGLVQPGGSLRLSCAASGRTFSNNVMGWFRQAPGKERELVAAAISG
GSTYYADSVKGRFTISADNSKNTAYLQMNSLKPEDTAVYYCARGDWRYGWGQG
TLVTVSS 7-28 2329 EVQLVESGGGLVQPGGSLRLSCAASGRTFSISAMGWFRQAPGKEREFVAAISRSGT
TMYADSVKGRFTISADNSKNTAYLQMNSLKP EDTAVYYCAAQLGYESGYSLTYD
YDWGQGTLVTVSS 7-29 2330 EVQLVESGGGLVQPGGSLRLSCAASGGTFSYYDLAAMGWFRQAPGKEREFVAAIS
WSQYNTKYADSVKGRFTISADNSKNTAYLQMNSLKPEDTAVYYCAARVVVRTA
HGFEDNWGQGTLVTVSS 7-30 2331 EVQLVESGGGLVQPGGSLRLSCAASGRTFNNYGMGWFRQAPGKEREFVAVISRSG
SLKAYADSVKGRFTISADNSKNTAYLQMNSLKPEDTAVYYCASDPTYGSRWTW
VGQGTLVTVSS TABLE 39-continued

| SARS-CoV-2 Variant Variable Heavy Chain Sequences | | |
|---|---|---|
| 7-31 | 2332 | EVQLVESGGGLVQPGGSLRLNCAASGFTLDDYVMGWFRQTPGKEREFVAAISSSGALTSYADSVKGRFTISADNSKNTAYLQMNSLKPEDAAVYYCAAKEYGGTRRYDRAYNWGQGTLVTVSS |
| 7-32 | 2333 | EVQLVESGGGLVQPGGSLRLSCAASGRTFNAMGWFRQAPGKEREFVAAIRWSGDMSVYADSVKGRFTISADNSKNTAYLQMNSLKPEDTAVYYCAAQDRRRGDYYTFDYHWGQGTLVTVSS |
| 7-33 | 2334 | EVQLVESGGGLVQPGGSLRLSCAASGLTFSTYAMGWFRQAPGKEREFVAAITSGGSTDYADSVKGRFTISADNSKNTAYLQMNSLKPEDTAVYYCARGDWRYGWGQGTLVTVSS |
| 7-34 | 2335 | EVQLVESGGGLVQPGGSLRLSCAASGSIFTINAMGWFRQAPGKEREGVAAIGSDGSTSYADSVKGRFTISADNSKNTAYLQMNSLKPEDTAVYYCAVVRWGADWGQGTLVTVSS |
| 7-35 | 2336 | EVQLVESGGGLVQPGGSLRLSCAASGLTFSSYAMGWFRQAPGKERELVAAITSSSGSTPAYADSVKGRFTISADNSKNTAYLQMNSLKPEDTAVYYCARGDWRYGWGQGTLVTVSS |
| 7-36 | 2337 | EVQLVESGGGLVQPGGSLRLSCAASGIPFSTRTMGWFRQAPGKEREFVAAISWSQYNTKYADSVKGRFTISADNSKNTAYLQMNSLKPEDTAVYYCAARHWGMFSRSENDYNWGQGTLVTVSS |
| 7-37 | 2338 | EVQLVESGGGLVQPGGSLRLSCAASGRSRFSTYVMGWFRQAPGKEREFVAAISWSQYNTKYADSVKGRFTISADNSKNTAYLQMNSLKPEDTAVYYCAAGNGGRNYGHSRARYDWGQGTLVTVSS |
| 7-38 | 2339 | EVQLVESGGGLVQPGGSLRLSCAASGLTLSSYGMGWFRQAPGKEREYVAVISRSGSLKAYADSVKGRFTISADNSKNTAYLQMNSLKPEDTAVYYCATRADAEGWWDWGQGTLVTVSS |
| 7-39 | 2340 | EVQLVESGGGLVQPGGSLRLSCAASGSIFRVNVMGWFRQAPGKEREFVAAINNFGTTKYADSVKGRFTISADNSKNTAYLQMNSLKPEDTAVYYCAADLPSRWGQGTLVTVSS |
| 7-40 | 2341 | EVQLVESGGGLVQPGGSLRLSCAASGRTFRNYAMGWFRQAPGKERELVAAISSGGSTDYADSVKGRFTISADNSKNTAYLQMNSLKPEDTAVYYCARGDWRYGWGQGTLVTVSS |
| 7-41 | 2342 | EVQLVESGGGLVQPGGSLRLSCAASGRTFSSFAMGWFRQAPGKERELVAAISSGGSTNYADSVKGRFTISADNSKNTAYLQMNSLKPEDTAVYYCARGDWRYGWGQGTLVTVSS |
| 7-42 | 2343 | EVQLVESGGGLVQPGGSLRLSCAASGTTFRINAMGWFRQAPGKEREFVAAMNWSGGSTKYADSVKGRFTISADNSKNTAYLQMNSLKPEDTAVYYCAAQDRRRGDYYTFDYHWGQGTLVTVSS |
| 7-43 | 2344 | EVQLVESGGGLVQPGGSLRLSCAASGFTLGDYVMGWFRQAPGKEREFVAAIHSGGSTLYADSVKGRFTISADNSKNTAYLQMNSLKPEDTAVYYCAAKEYGGTRRYDRTYNWGQGTLVTVSS |
| 7-44 | 2345 | EVQLVESGGGLVQPGGSLRLSCAASGFTFSRSAMGWFRQAPGKERELVAGILSSGATVYADSVKGRFTISADNSKNTAYLQMNSLKPEDTAVYYCAKAPRDWGQGTLVTVSS |
| 7-45 | 2346 | EVQLVESGGGLVQPGGSLRLSCAASGRTFNNYAMGWFRQAPGKERELVAAITSGGSTDYADSVKGRFTISADNSKNTAYLQMNSLKPEDTAVYYCARGDWRYGWGQGTLVTVSS |
| 7-46 | 2347 | EVQLVESGGGLVQPGGSLRLSCAASGFTFRSYPMGWFRQAPGKEREFVAAINNFGTTKYADSVKGRFTISADNSKNTAYLQMNSLKPEDTAVYYCAAAKGIGVYGWGQGTLVTVSS |
| 7-47 | 2348 | EVQLVESGGGLVQPGGSLRLSCAASGNIFTRNVMGWFRQAPGKEREFVAAIHWNGDSTKYADSVKGRFTISADNSKNTAYLQMNSLKPEDTAVYYCAAGSNIGGSRWRYDWGQGTLVTVSS |
| 7-48 | 2349 | EVQLVESGGGLVQPGGSLRLSCAASGRTISRYTMGWFRQAPGKERELVAAIKWSGASTVYADSVKGRFTISADNSKNTAYLQMNSLKPEDTAVYYCAAKGIWDYLGRRDFGDWGQGTLVTVSS |
| 7-49 | 2350 | EVQLVESGGGLVQPGGSLRLSCAASGFRFSSYGMGWFRQAPGKEREFVAIITSGGLTVYADSVKGRFTISADNSKNTAYLQMNSLKPEDTAVYYCAARKTFYFGTSSYPNDYAWGQGTLVTVSS |

TABLE 39-continued

SARS-CoV-2 Variant Variable Heavy Chain Sequences

| | | |
|---|---|---|
| 7-50 | 2351 | EVQLVESGGGLVQPGGSLRLSCAASGRTFDNHAMGWFRQAPGKEREGVAAIGSDGSTSYADSVKGRFTISADNSKNTAYLQMNSLKPEDTAVYYCAVVRWGVDWGQGTLVTVSS |
| 7-51 | 2352 | EVQLVESGGGLVQPGGSLRLSCAASGFTFSSHAMGWFRQAPGKEREFVAGISWSGESTLTRYADSVKGRFTISADNSKNTAYLQMNSLKPEDTAVYYCADVNGDWGQGTLVTVSS |
| 7-52 | 2353 | EVQLVESGGGLVQPGGSLRLSCAASGMTFRLYAMGWFRQAPGKEREFVAAISWSQYNTKYADSVKGRFTISADNSKNTAYLQMNSLKPEDTAVYYCAAQLGYESGYSLTYDYDWGQGTLVTVSS |
| 7-53 | 2354 | EVQLVESGGGLVQPGGSLRLSCAASGGTFRKLAMGWFRQAPGKEREFVAVISWTGGSSYYADSVKGRFTISADNSKNTAYLQMNSLKPEDTAVYYCARLTSFATWGQGTLVTVSS |
| 7-54 | 2355 | EVQLVESGGGLVQPGGSLRLSCAASGRTFSANGMGWFRQAPGKEREFVAAISASGTLRAYADSVKGRFTISADNSKNTAYLQMNSLKPEDTAVYYCAARSPMSPTWDWGQGTLVTVSS |
| 7-55 | 2356 | EVQLVESGGGLVQPGGSLRLSCAASGSAFRSTVMGWFRQAPGKEREFVAAISWTGESTLYADSVKGRFTISADNSKNTAYLQMNSLKPEDTAVYYCATGPYRSYFARSYLWGQGTLVTVSS |
| 7-56 | 2357 | EVQLVESGGGLVQPGGSLRLSCAASGGTFDYSGMGWFRQAPGKEREFVAVVSQSGRTTYYADSVKGLFTITADNSKNTAYLQMNLLKPEDTAVYYCPTATRPGEWDGGQGTLVTVSR |
| 7-57 | 2358 | EVQLVESGGGLVQPGGSLRLSCAASGVFGPIRAMGWFRQAPGKERELVALMGNDGSTYADSVKGRFTISADNSKNTAYLQMNSLKPEDTAVYYCAAIGWRWGQGTLVTVSS |
| 7-58 | 2359 | EVQLVESGGGLVQPGGSLRLSCAASGFNFNWYPMGWFRQAPGKEREFVAAIRWSGGITYYADSVKGRFTISADNSKNTAYLQMNSLKPEDTAVYYCATGPYRSYFARSYLWGQGTLVTVSS |
| 7-59 | 2360 | EVQLVESGGGLVQPGGSLRLSCAASGMTFHRYVMGWFRQAPGKERELVASITTGGTPNYADSVKGRFTIITDNNKNTAYLLMINLQPEDTAVYYCCKVPYIWGQGTLGTVGT |
| 7-60 | 2361 | EVQLVESGGGLVQPGGSLRLSCAASGISTMGWFRQAPGKEREFVAAINNFGTTKYADSVKGRFTISADNSKNTAYLQMNSLKPEDTAVYYCAAASQSGSGYDWGQGTLVTVSS |
| 7-61 | 2362 | EVQLVESGGGLVQPGGSLRLSCAASGRAFNTRAMGWFRQAPGKERELVALMGNDGSTYADSVKGRFTISADNSKNTAYLQMNSLKPEDTAVYYCAAIGWRWGQGTLVTVSS |
| 7-62 | 2363 | EVQLVESGGGLVQPGGSLRLSCAASGLTDRRYTMGWFRQAPGKEREFVAAINSGGSTLYADSVKGRFTISADNSKNTAYLQMNSLKPEDTAVYYCAAGNGGRTYGHSRARYEWGQGTLVTVSS |
| 7-63 | 2364 | EVQLVESGGGLVQPGGSLRLSCAASGRTFNVMGWFRQAPGKERELVALMGNDGSTYADSVKGRFTISADNSKNTAYLQMNSLKPEDTAVYYCAAVRWGVDWGQGTLVTVSS |
| 7-64 | 2365 | EVQLVESGGGLVQPGGSLRLSCAASGRAFNTRAMGWFRQAPGKERELVALMGNDGSTNYADSVKGRFTISADNSKNTAYLQMNSLKPEDTAVYYCAAIGWRWGQGTLVTVSS |
| 7-65 | 2366 | EVQVVESGGGVVHPGGSVRMRCAASGVTVDYSGMGWFGQAPGKEREFVAVVSQSARTTYYADSVKGRFTISADNSKNTEYLQMNSMKPEDTAVYYCATATRPGEWDWGQGTLVTVSS |
| 7-66 | 2367 | EVQLVESGGGLVQPGGSLRLSCAASGRTPRLGAMGWFRQAPGKEREFVAAISRSGGLTSYADSVKGRFTISADNSKNTAYLQMNSLKPEDTAVYYCAAQLVGSNIGGSRWRYDWGQGTLVTVSS |
| 7-67 | 2368 | EVQLVESGGGLVQPGGSLRLSCAASGLTFRNYAMGWFRQAPGKEREFVAAITSGGSTLYADSVKGRFTISADNSKNTAYLQMNSLKPEDTAVYYCARGDWRYGWGHGTLVTESS |
| 8-1 | 2369 | EVQLVESGGGLVQPGGSLRLSCAASGGRTFSDLAMGWFRQAPGKEREFVALITRSGGTTFYADSVKGRFTISADNSKNTAYLQMNSLKPEDTAVYYCAIGRGSWGQGTLVTVSS |

TABLE 39-continued

SARS-CoV-2 Variant Variable Heavy Chain Sequences 8-2  2370  EVQLVESGGGL

TABLE 40-continued

Membrane Protein CDR Sequences

| Variant | SEQ ID NO | CDRH1 | SEQ ID NO | CDRH2 | SEQ ID NO | CDRH3 |
|---|---|---|---|---|---|---|
| 9-9 | 2389 | GTLRGYGMG | 2461 | ASISRSGGSTYYA | 2533 | CAARRVTLFTSRADYDW |
| 9-10 | 2390 | RMFSSRSMG | 2462 | ALINRSGGSQFYA | 2534 | CAARRWIPPGPIW |
| 9-11 | 2391 | RTFGRRAMG | 2463 | AGISRGGGTNYA | 2535 | CAAKGIWDYLGRRDFGDW |
| 10-1 | 2392 | LSSPPFDDFPBMG | 2464 | SSIYSDDGDSMYA | 2536 | CARQTFDFWSASLGGNFWYFDLW |
| 10-2 | 2393 | GTFSSYSMG | 2465 | SAISWIIGSGGTTNYA | 2537 | CTAGAGDSW |
| 10-3 | 2394 | SIFSTRTMG | 2466 | ASITKFGSTNYA | 2538 | CTRGGGRFFDWLYLRW |
| 10-4 | 2395 | RTLWRSNMG | 2467 | ASISSFGSTKYA | 2539 | CARGHGRYFDWLLFARPPDYW |
| 10-5 | 2396 | RSLGIYRMG | 2468 | AAITSGGRKNYA | 2540 | CAKRTIFGVGRWLDPW |
| 10-6 | 2397 | TTLTFRIMG | 2469 | PAISSTGLASYT | 2541 | CSKDRAPNCFACCPNGFDVW |
| 10-7 | 2398 | SRFSGRFNILNMG | 2470 | ARIGYSGQSISYA | 2542 | CARGRFLGGTEW |
| 10-8 | 2399 | TLFKINAMG | 2471 | AQINRHGVTYYA | 2543 | CARGRTIFFGGGRYFDYW |
| 10-9 | 2400 | IPFRSRTMG | 2472 | AGITGSGRSQYYA | 2544 | CARGARIFGSVAPWRGGNYYGMDVW |
| 10-10 | 2401 | FTFSSFRMG | 2473 | AGISRGGSTNYA | 2545 | CARASGLWFRRPHVW |
| 10-11 | 2402 | RNFRRNSMG | 2474 | AGISWSGARTHYA | 2546 | CARVSRRPRSPPGYYYGMDVW |
| 10-12 | 2403 | RNLRMYRMG | 2475 | ATIRWSDGSTYYA | 2547 | CTRARLRYFDWLFPTNFDYW |
| 10-13 | 2404 | GLTFSSNTMG | 2476 | ASISSSGRTSYA | 2548 | CARRVRRLWFRSYFDLW |
| 10-14 | 2405 | FTLAYYAMG | 2477 | AAISWSGRNINYA | 2549 | CARERARWFGKFSVSW |
| 10-15 | 2406 | RTFSSFPMG | 2478 | AAISWSGSTSYA | 2550 | SACGRLGFGAW |
| 10-16 | 2407 | ISSSKRNMG | 2479 | ATWTSRGITTYA | 2551 | CARGGPPRLWGSYRRKYFDYW |
| 10-17 | 2408 | RTFSIYAMG | 2480 | ARTIRGGITKYA | 2552 | CARGLGWLLGYYW |
| 10-18 | 2409 | RMYNSYSMG | 2481 | ARISPGGTFYA | 2553 | CTTSARSGWFWRYFDSW |
| 10-19 | 2410 | RTFRSYGMG | 2482 | ASISRSGTTMYA | 2554 | CARRGLLQWFGAPNSWFDPW |
| 10-20 | 2411 | RTIRTMG | 2483 | ATINSRGITNYA | 2555 | CTTERDGLLWFRELFRPSW |
| 10-21 | 2412 | RSFSFNAMG | 2484 | ARISRFGRTNYA | 2556 | CAKVHSYVWGGHSDYW |
| 10-22 | 2413 | RTYYAMG | 2485 | GAIDWSGRRITYA | 2557 | CARVRFSRLGGVIGRPIDSW |
| 10-23 | 2414 | RAFRRYTMG | 2486 | ASITKFGSTNYA | 2558 | CAKDRGVLWFGELWYW |
| 10-24 | 2415 | RTFSNYRMG | 2487 | ASINRGGSTKYA | 2559 | CASGKGGSATIFHLSRRPLYFDYW |
| 10-25 | 2416 | ITFSPYAMG | 2488 | ATINWSGGYTVYA | 2560 | CAKRKNRGPLWFGGGGWGYW |

TABLE 40-continued

Membrane Protein CDR Sequences

| Variant | SEQ ID NO | CDRH1 | SEQ ID NO | CDRH2 | SEQ ID NO | CDRH3 |
|---|---|---|---|---|---|---|
| 10-26 | 2417 | RTFSGFTMSSTWMG | 2489 | AGIITNGSTNYA | 2561 | CARRVAYSSFWSGLRKHMDVW |
| 10-27 | 2418 | RTFRRYSMG | 2490 | ASITPGGNTNYA | 2562 | CASRRRWLTPYIFW |
| 10-28 | 2419 | SIFSIGMG | 2491 | ARIWWRSGATYYA | 2563 | CAAISIFGRLKW |
| 10-29 | 2420 | RTFTSYRMG | 2492 | AEISSSGGYTYYA | 2564 | CARVGPLRFLAQRPRLRPDYW |
| 10-30 | 2421 | RTFSSFRFRAMG | 2493 | ALIFSGGSTYYA | 2565 | CAREWGRWLQRGSYW |
| 10-31 | 2422 | RTFGSYGMG | 2494 | ATISIGGRTYYA | 2566 | CARGSGSGFMWYHGNNNYDRWRYW |
| 10-32 | 2423 | RTFRSYPMG | 2495 | ASINRGGSTNYA | 2567 | CARGRYDFWSGYYRWFDPW |
| 10-33 | 2424 | RTFSRSDMG | 2496 | AAISWSGGSTSYA | 2568 | CATVPPPRRFLEWLPRRLTYIW |
| 10-34 | 2425 | RTFRRYTMG | 2497 | ASMRGSRSYYA | 2569 | CARMSGFPFLDYW |
| 10-35 | 2426 | SIFRLSTMG | 2498 | ASISSFGSTYYA | 2570 | CARTRGIFLWFGESFDYW |
| 10-36 | 2427 | IAFRIRTMG | 2499 | ASITSGGSTNYA | 2571 | CARGGPRFGGFRGYFDPW |
| 10-37 | 2428 | FTFTSYRMG | 2500 | AGISRFFGTAYYA | 2572 | CARVTRWFGGLDVW |
| 10-38 | 2429 | RTFSRYVMG | 2501 | ASISRFGRTNYA | 2573 | CARHHGLGILWWGTMDVW |
| 10-39 | 2430 | RTFSMG | 2502 | ASISRFGRTNYA | 2574 | CAKRSTWLPQHFDSW |
| 10-40 | 2431 | RTFSTYTMG | 2503 | ARIWRSGGNTYYA | 2575 | CARGVRGVFRAYFDHW |
| 10-41 | 2432 | RNLRMYRMG | 2504 | ALISRVGVTSYA | 2576 | CARGTSFFNFWSGSLGRVGFDSW |
| 10-42 | 2433 | ITIRTHAMG | 2505 | ATISRSGGNTYYA | 2577 | CTTAGVLRYFDWFRRPYW |
| 10-43 | 2434 | RTFRRYHMG | 2506 | AAITSGGRTNYA | 2578 | CTTDGLRYFDWFPWASAFDIW |
| 10-44 | 2435 | RTFRRYTMG | 2507 | AVISWSGGSTKYA | 2579 | CARKGRWSGMNVW |
| 10-45 | 2436 | RTFSWYPMG | 2508 | ASISWGGARTYYA | 2580 | CARSTGPRGSGRYRAHWFDSW |
| 10-46 | 2437 | RTFTSYRMG | 2509 | AAITWNSGRTRYA | 2581 | CSPSSWPFYFGAW |
| 10-47 | 2438 | RPLRRYVMG | 2510 | AAITNGGSTKYA | 2582 | CARGTPWRLLWFGTLGPPPAFDYW |
| 10-48 | 2439 | RTFRRYAMG | 2511 | AAINRSGSTEYA | 2583 | CARQHQDFWTGYYTVW |
| 10-49 | 2440 | RTFRRYTMG | 2512 | ASISRSGTTYYA | 2584 | CAKEGWRWLQLRGGFDYW |
| 10-50 | 2441 | RTLSTYNMG | 2513 | ASISRFGRTNYA | 2585 | CARRGKLSAAMHWFDPW |
| 10-51 | 2442 | RFFSTRVMG | 2514 | ARIWPGGSTYYA | 2586 | CARDRGIFGVSRW |
| 10-52 | 2443 | RFFSICSMG | 2515 | AGINWRSGGSTYYA | 2587 | CARGSGWWEYW |
| 10-53 | 2444 | RMFSSRSNMG | 2516 | ASISSGGTTAYA | 2588 | CARGFGRRFLEWLPRFDYW |
| 10-54 | 2445 | RTFSSARMG | 2517 | AGINMISSTKYA | 2589 | CAHFRRFLPRGYVDYW |

TABLE 40-continued

Membrane Protein CDR Sequences

| Variant | SEQ ID NO | CDRH1 | SEQ ID NO | CDRH2 | SEQ ID NO | CDRH3 |
|---|---|---|---|---|---|---|
| 10-55 | 2446 | RTFRRYTMG | 2518 | ARIAGGSTYYA | 2590 | CARQQYYDFWSGYFRSGYFDLW |
| 10-56 | 2447 | HTFRNYGMG | 2519 | AAITSSGSTNYA | 2591 | CATVPPPRRFLEWLPRRLTYTW |
| 10-57 | 2448 | RTFSRYAMG | 2520 | ASITKFGSTNYA | 2592 | CAKERESRFLKWRKTDW |
| 10-58 | 2449 | RNLRMYRMG | 2521 | ASISRFGRTNYA | 2593 | CARHDSIGLFRHGMDVW |
| 10-59 | 2450 | RTFRRYAMG | 2522 | ARISSGGSTSYA | 2594 | CARDRGFGFWSGLRGYFDLW |
| 10-60 | 2451 | IPASMYLG | 2523 | AAITSGGRTSYA | 2595 | CAKRKKRGPLWFGGGGWGYW |
| 10-61 | 2452 | IPFRSRTFSAYAMG | 2524 | AQITRGGSTNYA | 2596 | CARRHWFGFDYW |

TABLE 41

Membrane Protein VH Sequences

| Variant | SEQ ID NO | VH |
|---|---|---|
| 9-1 | 2597 | EVQLVESGGGLVQPGGSLRLSCAASGRTFSRLAMGWFRQAPGKEREFVAAISRSGRSTSYADSVKGRFTISADNSKNTAYLQMNSLKPEDTAVYYCAARRSQILFTSRTDYEWGQGTLVTVSS |
| 9-2 | 2598 | EVQLVESGGGLVQPGGSLRLSCAASGSFSIAAMGWFRQAPGKEREFVATINYSGGGTYYADSVKGRFTISADNSKNTAYLQMNSLKPEDTAVYYCAAVNTFDESAYAAFACYDVVWGQGTLVTVSS |
| 9-3 | 2599 | EVQLVESGGGLVQPGGSLRLSCAASGRTFSRYAMGWFRQAPGKEREFVAAISRSGKSTYYADSVKGRFTISADNSKNTAYLQMNSLKPEDTAVYYCAASSVFSDLRYRKNPKWGQGTLVTVSS |
| 9-4 | 2600 | EVQLVESGGGLVQPGGSLRLSCAASGRTFSKYAMGWFRQAPGKEREFVSHISRDGGRTFSSSTMGWFRQAPGKERELVALITPSSRTTYYADSVKGRFTISADNSKNTAYLQMNSLKPEDTAVYYCAIAGRGRWGQGTLVTVSS |
| 9-5 | 2601 | EVQLVESGGGLVQPGGSLRLSCAASGRTFRRYAMGWFRQAPGKEREFVASINWGGGNTYYADSVKGRFTISADNSKNTAYLQMNSLKPEDTAVYYCAKTKRTGIFTTARMVDWGQGTLVTVSS |
| 9-6 | 2602 | EVQLVESGGGLVQPGGSLRLSCAASGRTFSRFAMGWFRQAPGKEREFVAAIRWSGGRTVYADSVKGRFTISADNSKNTAYLQMNSLKPEDTAVYYCAIEPGTIRNWRNRVPFARGNFGWGQGTLVTVSS |
| 9-7 | 2603 | EVQLVESGGGLVQPGGSLRLSCAASGLGIAFSRRTAMGWFRQAPGKEREFVAAISWRGGNTYYADSVKGRFTISADNSKNTAYLQMNSLKPEDTAVYYCAARRWIPPGPIWGQGTLVTVSS |
| 9-8 | 2604 | EVQLVESGGGLVQPGGSLRLSCAASGRTFRRYPMGWFRQAPGKEREFVAAISRSGGSTYYADSVKGRFTISADNSKNTAYLQMNSLKPEDTAVYYCAAKRLRSFASGGSYDWGQGTLVTVSS |
| 9-9 | 2605 | EVQLVESGGGLVQPGGSLRLSCAASGGTLRGYGMGWFRQAPGKEREFVASISRSGGSTYYADSVKGRFTISADNSKNTAYLQMNSLKPEDTAVYYCAARRVTLFTSRADYDWGQGTLVTVSS |
| 9-10 | 2606 | EVQLVESGGGLVQPGGSLRLSCAASGRMFSSRSMGWFRQAPGKEREFVALINRSGGSQFYADSVKGRFTISADNSKNTAYLQMNSLKPEDTAVYYCAARRWIPPGPIWGQGTLVTVSS |
| 9-11 | 2607 | EVQLVESGGGLVQPGGSLRLSCAASGRTFGRRAMGWFRQAPGKEREFVAGISRGGGTNYADSVKGRFTISADNSKNTAYLQMNSLKPEDTAVYYCAAKGIWDYLGRRDFGDWGQGTLVTVSS |

TABLE 41-continued

Membrane Protein VH Sequences

| Variant | SEQ ID NO | VH |
|---|---|---|
| 10-1 | 2608 | EVQLVESGGGLVQPGGSLRLSCAASGLSSPPFDDFPMGWFRQAPGKEREFVSSIYSDDGDSMYADSVKGRFTISADNSKNTAYLQMNSLKPEDTAVYYCARQTFDFWSASLGGNFWYFDLWGQGTLVTVSS |
| 10-2 | 2609 | EVQLVESGGGLVQPGGSLRLSCAASGGTFSSYSMGWFRQAPGKEREFVSAISWIIGSGGTTNYADSVKGRFTISADNSKNTAYLQMNSLKPEDTAVYYCTAGAGDSWGQGTLVTVSS |
| 10-3 | 2610 | EVQLVESGGGLVQPGGSLRLSCAASGSIFSTRTMGWFRQAPGKEREFVASITKFGSTNYADSVKGRFTISADNSKNTAYLQMNSLKPEDTAVYYCTRGGGRFFDWLYLRWGQGTLVTVSS |
| 10-4 | 2611 | EVQLVESGGGLVQPGGSLRLSCAASGRTLWRSNMGWFRQAPGKEREFVASISSFGSTKYADSVKGRFTISADNSKNTAYLQMNSLKPEDTAVYYCARGHGRYFDWLLFARPPDYWGQGTLVTVSS |
| 10-5 | 2612 | EVQLVESGGGLVQPGGSLRLSCAASGRSLGIYRMGWFRQAPGKEREFVAAITSGGRKNYADSVKGRFTISADNSKNTAYLQMNSLKPEDTAVYYCAKRTIFGVGRWLDPWGQGTLVTVSS |
| 10-6 | 2613 | EVQLVESGGGLVQPGGSLRLSCAASGTTLTFRIMGWFRQAPGKEREFVPAISSTGLASYTDSVKGRFTISADNSKNTAYLQMNSLKPEDTAVYYCSKDRAPNCFACCPNGFDVWGQGTLVTVSS |
| 10-7 | 2614 | EVQLVESGGGLVQPGGSLRLSCAASGSRFSGRFNILNMGWFRQAPGKEREFVARIGYSGQSISYADSVKGRFTISADNSKNTAYLQMNSLKPEDTAVYYCARGRFLGGTEWGQGTLVTVSS |
| 10-8 | 2615 | EVQLVESGGGLVQPGGSLRLSCAASGTLFKINAMGWFRQAPGKEREFVAQINRHGVTYYADSVKGRFTISADNSKNTAYLQMNSLKPEDTAVYYCARGRTIFFGGGRYFDYWGQGTLVTVSS |
| 10-9 | 2616 | EVQLVESGGGLVQPGGSLRLSCAASGIPFRSRTMGWFRQAPGKEREFVAGITGSGRSQYYADSVKGRFTISADNSKNTAYLQMNSLKPEDTAVYYCARGARIFGSVAPWRGGNYYGMDVWGQGTLVTVSS |
| 10-10 | 2617 | EVQLVESGGGLVQPGGSLRLSCAASGFTFSSFRMGWFRQAPGKEREFVAGISRGGSTNYADSVKGRFTISADNSKNTAYLQMNSLKPEDTAVYYCARASGLWFRRPHVWGQGTLVTVSS |
| 10-11 | 2618 | EVQLVESGGGLVQPGGSLRLSCAASGRNFRRNSMGWFRQAPGKEREFVAGISWSGARTHYADSVKGRFTISADNSKNTAYLQMNSLKPEDTAVYYCARVSRRPRSPPGYYYGMDVWGQGTLVTVSS |
| 10-12 | 2619 | EVQLVESGGGLVQPGGSLRLSCAASGRNLRMYRMGWFRQAPGKEREFVATIRWSDGSTYYADSVKGRFTISADNSKNTAYLQMNSLKPEDTAVYYCTRARLRYFDWLFPTNFDYWGQGTLVTVSS |
| 10-13 | 2620 | EVQLVESGGGLVQPGGSLRLSCAASGGLTFSSNTMGWFRQAPGKEREFVASISSSGRTSYADSVKGRFTISADNSKNTAYLQMNSLKPEDTAVYYCARRVRRLWFRSYFDLWGQGTLVTVSS |
| 10-14 | 2621 | EVQLVESGGGLVQPGGSLRLSCAASGFTLAYYAMGWFRQAPGKEREFVAAISWSGRNINYADSVKGRFTISADNSKNTAYLQMNSLKPEDTAVYYCARERARWFGKFSVSWGQGTLVTVSS |
| 10-15 | 2622 | EVQLVESGGGLVQPGGSLRLSCAASGRTFSSFPMGWFRQAPGKEREFVAAISWGSTSYADSVKGRFTISADNSKNTAYLQMNSLKPEDTAVYYSACGRLGFGAWGQGTLVTVSS |
| 10-16 | 2623 | EVQLVESGGGLVQPGGSLRLSCAASGISSSKRNMGWFRQAPGKEREFVATWTSRGITTYADSVKGRFTISADNSKNTAYLQMNSLKPEDTAVYYCARGGPPRLWGSYRRKYFDYWGQGTLVTVSS |
| 10-17 | 2624 | EVQLVESGGGLVQPGGSLRLSCAASGRTFSIYAMGWFRQAPGKEREFVARITRGGITKYADSVKGRFTISADNSKNTAYLQMNSLKPEDTAVYYCARGLGWLLGYYWGQGTLVTVSS |
| 10-18 | 2625 | EVQLVESGGGLVQPGGSLRLSCAASGRMYNSYSMGWFRQAPGKEREFVARISPGGTFYADSVKGRFTISADNSKNTAYLQMNSLKPEDTAVYYCTTSARSGWFWRYFDSWGQGTLVTVSS |

TABLE 41-continued

Membrane Protein VH Sequences

| Variant | SEQ ID NO | VH |
|---|---|---|
| 10-19 | 2626 | EVQLVESGGGLVQPGGSLRLSCAASGRTFRSYGMGWFRQAPGKEREFVASISRSG<br>TTMYADSVKGRFTISADNSKNTAYLQMNSLKPEDTAVYYCARRGLLQWFGAPNS<br>WFDPWGQGTLVTVSS |
| 10-20 | 2627 | EVQLVESGGGLVQPGGSLRLSCAASGRTIRTMGWFRQAPGKEREFVATINSRGITN<br>YADSVKGRFTISADNSKNTAYLQMNSLKPEDTAVYYCTTERDGLLWFRELFRPSW<br>GQGTLVTVSS |
| 10-21 | 2628 | EVQLVESGGGLVQPGGSLRLSCAASGRSFSFNAMGWFRQAPGKEREFVARISRFG<br>RTNYADSVKGRFTISADNSKNTAYLQMNSLKPEDTAVYYCAKVHSYVWGGHSD<br>YWGQGTLVTVSS |
| 10-22 | 2629 | EVQLVESGGGLVQPGGSLRLSCAASGRTYYAMGWFRQAPGKEREFVGAIDWSGR<br>RITYADSVKGRFTISADNSKNTAYLQMNSLKPEDTAVYYCARVRFSRLGGVIGRPI<br>DSWGQGTLVTVSS |
| 10-23 | 2630 | EVQLVESGGGLVQPGGSLRLSCAASGRAFRRYTMGWFRQAPGKEREFVASITKFG<br>STNYADSVKGRFTISADNSKNTAYLQMNSLKPEDTAVYYCAKDRGVLWFGELWY<br>WGQGTLVTVSS |
| 10-24 | 2631 | EVQLVESGGGLVQPGGSLRLSCAASGRTFSNYRMGWFRQAPGKEREFVASINRGG<br>STKYADSVKGRFTISADNSKNTAYLQMNSLKPEDTAVYYCASGKGGSATIFHLSR<br>RPLYFDYWGQGTLVTVSS |
| 10-25 | 2632 | EVQLVESGGGLVQPGGSLRLSCAASGITFSPYAMGWFRQAPGKEREFVATINWSG<br>GYTVYADSVKGRFTISADNSKNTAYLQMNSLKPEDTAVYYCAKRKNRGPLWFGG<br>GGWGYWGQGTLVTVSS |
| 10-26 | 2633 | EVQLVESGGGLVQPGGSLRLSCAASGRTFSGFTMSSTWMGWFRQAPGKEREFVA<br>GIITNGSTNYADSVKGRFTISADNSKNTAYLQMNSLKPEDTAVYYCARRVAYSSF<br>WSGLRKHMDVWGQGTLVTVSS |
| 10-27 | 2634 | EVQLVESGGGLVQPGGSLRLSCAASGRTFRRYSMGWFRQAPGKEREFVASITPGG<br>NTNYADSVKGRFTISADNSKNTAYLQMNSLKPEDTAVYYCASRRRWLTPYIFWG<br>QGTLVTVSS |
| 10-28 | 2635 | EVQLVESGGGLVQPGGSLRLSCAASGSIFSIGMGWFRQAPGKEREFVARIWWRSG<br>ATYYADSVKGRFTISADNSKNTAYLQMNSLKPEDTAVYYCAAISIFGRLKWGQGT<br>LVTVSS |
| 10-29 | 2636 | EVQLVESGGGLVQPGGSLRLSCAASGRTFTSYRMGWFRQAPGKEREFVAEISSSG<br>GYTYYADSVKGRFTISADNSKNTAYLQMNSLKPEDTAVYYCARVGPLRFLAQRP<br>RLRPDYWGQGTLVTVSS |
| 10-30 | 2637 | EVQLVESGGGLVQPGGSLRLSCAASGRTFSSFRFRAMGWFRQAPGKEREFVALIFS<br>GGSTYYADSVKGRFTISADNSKNTAYLQMNSLKPEDTAVYYCAREWGRWLQRGS<br>YWGQGTLVTVSS |
| 10-31 | 2638 | EVQLVESGGGLVQPGGSLRLSCAASGRTFGSYGMGWFRQAPGKEREFVATISIGG<br>VRTYYADSVKGRFTISADNSKNTAYLQMNSLKPEDTAVYYCARGSGSGFMWYHG<br>NNNYDRWRYWGQGTLVTVSS |
| 10-32 | 2639 | EVQLVESGGGLVQPGGSLRLSCAASGRTFRSYPMGWFRQAPGKEREFVASINRGG<br>STNYADSVKGRFTISADNSKNTAYLQMNSLKPEDTAVYYCARGRYDFWSGYYR<br>WFDPWGQGTLVTVSS |
| 10-33 | 2640 | EVQLVESGGGLVQPGGSLRLSCAASGRTFSRSDMGWFRQAPGKEREFVAAISWSG<br>GSTSYADSVKGRFTISADNSKNTAYLQMNSLKPEDTAVYYCATVPPPRRFLEWLP<br>RRLTYIWGQGTLVTVSS |
| 10-34 | 2641 | EVQLVESGGGLVQPGGSLRLSCAASGRTFRRYTMGWFRQAPGKEREFVASMRGS<br>RSYYADSVKGRFTISADNSKNTAYLQMNSLKPEDTAVYYCARMSGFPFLDYWGQ<br>GTLVTVSS |
| 10-35 | 2642 | EVQLVESGGGLVQPGGSLRLSCAASGSIFRLSTMGWFRQAPGKEREFVASISSFGST<br>YYADSVKGRFTISADNSKNTAYLQMNSLKPEDTAVYYCARTRGIFLWFGESFDY<br>WGQGTLVTVSS |
| 10-36 | 2643 | EVQLVESGGGLVQPGGSLRLSCAASGIAFRIRTMGWFRQAPGKEREFVASITSGGS<br>TNYADSVKGRFTISADNSKNTAYLQMNSLKPEDTAVYYCARGGP RFGGFRGYFDP<br>WGQGTLVTVSS |

TABLE 41-continued

Membrane Protein VH Sequences

| Variant | SEQ ID NO | VH |
|---|---|---|
| 10-37 | 2644 | EVQLVESGGGLVQPGGSLRLSCAASGFTFTSYRMGWFRQAPGKEREFVAGISRFF GTAYYADSVKGRFTISADNSKNTAYLQMNSLKPEDTAVYYCARVTRWF GGLDV WGQGTLVTVSS |
| 10-38 | 2645 | EVQLVESGGGLVQPGGSLRLSCAASGRTFSRYVMGWFRQAPGKEREFVASISRFG RTNYADSVKGRFTISADNSKNTAYLQMNSLKPEDTAVYYCARHHGLGILWWGT MDVWGQGTLVTVSS |
| 10-39 | 2646 | EVQLVESGGGLVQPGGSLRLSCAASGRTFSMGWFRQAPGKEREFVASISRFGRTN YADSVKGRFTISADNSKNTAYLQMNSLKPEDTAVYYCAKRSTWLPQHFDSWGQG TLVTVSS |
| 10-40 | 2647 | EVQLVESGGGLVQPGGSLRLSCAASGRTFSTYTMGWFRQAPGKEREFVARIWRSG GNTYYADSVKGRFTISADNSKNTAYLQMNSLKPEDTAVYYCARGVRGVFRAYFD HWGQGTLVTVSS |
| 10-41 | 2648 | EVQLVESGGGLVQPGGSLRLSCAASGRNLRMYRMGWFRQAPGKEREFVALISRV GVTSYADSVKGRFTISADNSKNTAYLQMNSLKPEDTAVYYCARGTSFFNFWSGSL GRVGFDSWGQGTLVTVSS |
| 10-42 | 2649 | EVQLVESGGGLVQPGGSLRLSCAASGITIRTHAMGWFRQAPGKEREFVATISRSGG NTYYADSVKGRFTISADNSKNTAYLQMNSLKPEDTAVYYCTTAGVLRYFDWFRR PYWGQGTLVTVSS |
| 10-43 | 2650 | EVQLVESGGGLVQPGGSLRLSCAASGRTFRRYHMGWFRQAPGKEREFVAAITSGG RTNYADSVKGRFTISADNSKNTAYLQMNSLKP EDTAVYYCTTD GLRYFDWFPWA SAFDIWGQGTLVTVSS |
| 10-44 | 2651 | EVQLVESGGGLVQPGGSLRLSCAASGRTFRRYTMGWFRQAPGKEREFVAVISWSG GSTKYADSVKGRFTISADNSKNTAYLQMNSLKPEDTAVYYCARKGRWSGMNVW GQGTLVTVSS |
| 10-45 | 2652 | EVQLVESGGGLVQPGGSLRLSCAASGRTFSWYPMGWFRQAPGKEREFVASISWG GARTYYADSVKGRFTISADNSKNTAYLQMNSLKPEDTAVYYCARSTGPRGSGRY RAHWFDSWGQGTLVTVSS |
| 10-46 | 2653 | EVQLVESGGGLVQPGGSLRLSCAASGRTFTSYRMGWFRQAPGKEREFVAAITWNS GRTRYADSVKGRFTISADNSKNTAYLQMNSLKPEDTAVYYCSPSSWPFYFGAWG QGTLVTVSS |
| 10-47 | 2654 | EVQLVESGGGLVQPGGSLRLSCAASGRPLRRYVMGWFRQAPGKEREFVAAITNG GSTKYADSVKGRFTISADNSKNTAYLQMNSLKPEDTAVYYCARGTPWRLLWFGT LGPPPAFDYWGQGTLVTVSS |
| 10-48 | 2655 | EVQLVESGGGLVQPGGSLRLSCAASGRTFRRYAMGWFRQAPGKEREFVAAINRSG STEYADSVKGRFTISADNSKNTAYLQMNSLKPEDTAVYYCARQHQDFWTGYYTV WGQGTLVTVSS |
| 10-49 | 2656 | EVQLVESGGGLVQPGGSLRLSCAASGRTFRRYTMGWFRQAPGKEREFVASISRSG TTYYADSVKGRFTISADNSKNTAYLQMNSLKPEDTAVYYCAKE GWRWLQLRGGF DYWGQGTLVTVSS |
| 10-50 | 2657 | EVQLVESGGGLVQPGGSLRLSCAASGRTLSTYNMGWFRQAPGKEREFVASISRFG RTNYADSVKGRFTISADNSKNTAYLQMNSLKP EDTAVYYCARRGKLSAAMHWF DPWGQGTLVTVSS |
| 10-51 | 2658 | EVQLVESGGGLVQPGGSLRLSCAASGRFFSTRVMGWFRQAPGKEREFVARIWPGG STYYADSVKGRFTISADNSKNTAYLQMNSLKPEDTAVYYCARDRGIFGVSRWGQ GTLVTVSS |
| 10-52 | 2659 | EVQLVESGGGLVQPGGSLRLSCAASGRFFSICSMGWFRQAPGKEREFVAGINWRS GGSTYYADSVKGRFTISADNSKNTAYLQMNSLKPEDTAVYYCARGSGWWEYWG QGTLVTVSS |
| 10-53 | 2660 | EVQLVESGGGLVQPGGSLRLSCAASGRMFSSRSNMGWFRQAPGKEREFVASISSG GTTAYADSVKGRFTISADNSKNTAYLQMNSLKPEDTAVYYCARGFGRRFLEWLP RFDYWGQGTLVTVSS |
| 10-54 | 2661 | EVQLVESGGGLVQPGGSLRLSCAASGRTFSSARMGWFRQAPGKEREFVAGINMIS STKYADSVKGRFTISADNSKNTAYLQMNSLKPEDTAVYYCAHFRRFLPRGYVDY WGQGTLVTVSS |

TABLE 41-continued

Membrane Protein VH Sequences

| Variant | SEQ ID NO | VH |
|---|---|---|
| 10-55 | 2662 | EVQLVESGGGLVQPGGSLRLSCAASGRTFRRYTMGWFRQAPGKEREFVARIAGGS TYYADSVKGRFTISADNSKNTAYLQMNSLKPEDTAVYYCARQQYYDFWSGYFRS GYFDLWGQGTLVTVSS |
| 10-56 | 2663 | EVQLVESGGGLVQPGGSLRLSCAASGHTFRNYGMGWFRQAPGKEREFVAAITSSG STNYADSVKGRFTISADNSKNTAYLQMNSLKPEDTAVYYCATVPPPRRFLEWLPR RLTYTWGQGTLVTVSS |
| 10-57 | 2664 | EVQLVESGGGLVQPGGSLRLSCAASGRTFSRYAMGWFRQAPGKEREFVASITKFG STNYADSVKGRFTISADNSKNTAYLQMNSLKPEDTAVYYCAKERESRFLKWRKT DWGQGTLVTVSS |
| 10-58 | 2665 | EVQLVESGGGLVQPGGSLRLSCAASGRNLRMYRMGWFRQAPGKEREFVASISRFG RTNYADSVKGRFTISADNSKNTAYLQMNSLKPEDTAVYYCARHDSIGLFRHGMD VWGQGTLVTVSS |
| 10-59 | 2666 | EVQLVESGGGLVQPGGSLRLSCAASGRTFRRYAMGWFRQAPGKEREFVARISSGG STSYADSVKGRFTISADNSKNTAYLQMNSLKPEDTAVYYCARDRGFGFWSGLRG YFDLWGQGTLVTVSS |
| 10-60 | 2667 | EVQLVESGGGLVQPGGSLRLSCAASGIPASMYLGWFRQAPGKEREFVAAITSGGR TSYADSVKGRFTISADNSKNTAYLQMNSLKPEDTAVYYCAKRKKRGPLWFGGGG WGYWGQGTLVTVSS |
| 10-61 | 2668 | EVQLVESGGGLVQPGGSLRLSCAASGIPFRSRTFSAYAMGWFRQAPGKEREFVAQI TRGGSTNYADSVKGRFTISADNSKNTAYLQMNSLKPEDTAVYYCARRHWFGFDY WGQGTLVTVSS |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (2673 sequences)

SEQ ID NO: 1 - protein, 9 aa, Artificial Sequence
  Description of Artificial Sequence: Synthetic peptide
RTFSDDTMG

SEQ ID NO: 2 - protein, 9 aa, Artificial Sequence
  Description of Artificial Sequence: Synthetic peptide
RTFGDYIMG

SEQ ID NO: 3 - protein, 9 aa, Artificial Sequence
  Description of Artificial Sequence: Synthetic peptide
RTFSDDAMG

SEQ ID NO: 4 - protein, 9 aa, Artificial Sequence
  Description of Artificial Sequence: Synthetic peptide
RTFGDYIMG

SEQ ID NO: 5 - protein, 9 aa, Artificial Sequence
  Description of Artificial Sequence: Synthetic peptide
RTFGDDTMG

SEQ ID NO: 6 - protein, 9 aa, Artificial Sequence
  Description of Artificial Sequence: Synthetic peptide
RTFGDDTMG

SEQ ID NO: 7 - protein, 9 aa, Artificial Sequence
  Description of Artificial Sequence: Synthetic peptide
RTFGDYIMG

SEQ ID NO: 8 - protein, 9 aa, Artificial Sequence
  Description of Artificial Sequence: Synthetic peptide
RTFGDYIMG

SEQ ID NO: 9 - protein, 9 aa, Artificial Sequence
  Description of Artificial Sequence: Synthetic peptide
RTFGDYIMG

SEQ ID NO: 10 - protein, 9 aa, Artificial Sequence
  Description of Artificial Sequence: Synthetic peptide
RTFSDDTMG

SEQ ID NO: 11 - protein, 9 aa, Artificial Sequence
  Description of Artificial Sequence: Synthetic peptide
RTFGDYAMG

SEQ ID NO: 12 - protein, 9 aa, Artificial Sequence
  Description of Artificial Sequence: Synthetic peptide
RTFGDDTMG

SEQ ID NO: 13 - protein, 9 aa, Artificial Sequence
  Description of Artificial Sequence: Synthetic peptide
RTFGDDTMG

SEQ ID NO: 14 - protein, 9 aa, Artificial Sequence
  Description of Artificial Sequence: Synthetic peptide
RTFSDDTMG

SEQ ID NO: 15 - protein, 9 aa, Artificial Sequence
  Description of Artificial Sequence: Synthetic peptide
RTFSDDTMG

SEQ ID NO: 16 - protein, 9 aa, Artificial Sequence
  Description of Artificial Sequence: Synthetic peptide
RTFSDYTMG

SEQ ID NO: 17 - protein, 9 aa, Artificial Sequence
  Description of Artificial Sequence: Synthetic peptide
RTFGDDTMG

SEQ ID NO: 18 - protein, 9 aa, Artificial Sequence
  Description of Artificial Sequence: Synthetic peptide
RTFGDYIMG

SEQ ID NO: 19 - protein, 9 aa, Artificial Sequence
  Description of Artificial Sequence: Synthetic peptide
RTFSDDTMG

SEQ ID NO: 20 - protein, 9 aa, Artificial Sequence
  Description of Artificial Sequence: Synthetic peptide
RTFGDDIMG

SEQ ID NO: 21 - protein, 9 aa, Artificial Sequence
  Description of Artificial Sequence: Synthetic peptide
RTFSDDTMG

SEQ ID NO: 22 - protein, 9 aa, Artificial Sequence
  Description of Artificial Sequence: Synthetic peptide
RTFGDYIMG

SEQ ID NO: 23 - protein, 9 aa, Artificial Sequence
  Description of Artificial Sequence: Synthetic peptide
RTFSDDAMG

SEQ ID NO: 24 - protein, 9 aa, Artificial Sequence
  Description of Artificial Sequence: Synthetic peptide
RTFSDYTMG

SEQ ID NO: 25 - protein, 9 aa, Artificial Sequence
  Description of Artificial Sequence: Synthetic peptide
GTFSRYAMG

SEQ ID NO: 26 - protein, 9 aa, Artificial Sequence
  Description of Artificial Sequence: Synthetic peptide
RTFSDDTMG

SEQ ID NO: 27 - protein, 9 aa, Artificial Sequence
  Description of Artificial Sequence: Synthetic peptide
RTFGDYIMG

SEQ ID NO: 28 - protein, 9 aa, Artificial Sequence
  Description of Artificial Sequence: Synthetic peptide
RTFGDDTMG

SEQ ID NO: 29 - protein, 9 aa, Artificial Sequence
  Description of Artificial Sequence: Synthetic peptide
RTFGDDTMG

SEQ ID NO: 30 - protein, 9 aa, Artificial Sequence
  Description of Artificial Sequence: Synthetic peptide
RTFGDYTMG

SEQ ID NO: 31 - protein, 9 aa, Artificial Sequence
  Description of Artificial Sequence: Synthetic peptide
RTFGDYIMG

SEQ ID NO: 32 - protein, 9 aa, Artificial Sequence
  Description of Artificial Sequence: Synthetic peptide
FTFDDYEMG

SEQ ID NO: 33 - protein, 9 aa, Artificial Sequence
  Description of Artificial Sequence: Synthetic peptide
FTFSRHDMG

SEQ ID NO: 34 - protein, 9 aa, Artificial Sequence
  Description of Artificial Sequence: Synthetic peptide
RTFGDYIMG

SEQ ID NO: 35 - protein, 11 aa, Artificial Sequence
  Description of Artificial Sequence: Synthetic peptide
QLANFASYAMG

SEQ ID NO: 36 - protein, 9 aa, Artificial Sequence
  Description of Artificial Sequence: Synthetic peptide
RTFGDYIMG

SEQ ID NO: 37 - protein, 9 aa, Artificial Sequence
  Description of Artificial Sequence: Synthetic peptide
RTFGDYGMG

SEQ ID NO: 38 - protein, 9 aa, Artificial Sequence
  Description of Artificial Sequence: Synthetic peptide
RTFSDDTMG

SEQ ID NO: 39 - protein, 9 aa, Artificial Sequence
  Description of Artificial Sequence: Synthetic peptide
RTFSNAAMG

SEQ ID NO: 40 - protein, 9 aa, Artificial Sequence
  Description of Artificial Sequence: Synthetic peptide
RTFSDDTMG

SEQ ID NO: 41 - protein, 9 aa, Artificial Sequence
  Description of Artificial Sequence: Synthetic peptide
RTFGDYIMG

SEQ ID NO: 42 - protein, 9 aa, Artificial Sequence
  Description of Artificial Sequence: Synthetic peptide
RTFGDDTMG

SEQ ID NO: 43 - protein, 9 aa, Artificial Sequence
  Description of Artificial Sequence: Synthetic peptide
RTFSDDTMG

SEQ ID NO: 44 - protein, 9 aa, Artificial Sequence
  Description of Artificial Sequence: Synthetic peptide
RTFGDYIMG

SEQ ID NO: 45 - protein, 9 aa, Artificial Sequence
  Description of Artificial Sequence: Synthetic peptide
RTFSDDAMG

SEQ ID NO: 46 - protein, 9 aa, Artificial Sequence
  Description of Artificial Sequence: Synthetic peptide
RTFGDYIMG

SEQ ID NO: 47 - protein, 9 aa, Artificial Sequence
  Description of Artificial Sequence: Synthetic peptide
FTFGDYVMG

SEQ ID NO: 48 - protein, 9 aa, Artificial Sequence
  Description of Artificial Sequence: Synthetic peptide
RTFSDDAMG

SEQ ID NO: 49 - protein, 9 aa, Artificial Sequence
  Description of Artificial Sequence: Synthetic peptide
RTFGDYIMG

SEQ ID NO: 50 - protein, 9 aa, Artificial Sequence
  Description of Artificial Sequence: Synthetic peptide
GTFSNSGMG

SEQ ID NO: 51 - protein, 13 aa, Artificial Sequence
  Description of Artificial Sequence: Synthetic peptide
GGISWSGGNTYYA

SEQ ID NO: 52 - protein, 13 aa, Artificial Sequence
  Description of Artificial Sequence: Synthetic peptide
AAINWSAGYTAYA

SEQ ID NO: 53 - protein, 13 aa, Artificial Sequence
  Description of Artificial Sequence: Synthetic peptide
AAINWSGGTTRYA

SEQ ID NO: 54 - protein, 13 aa, Artificial Sequence
  Description of Artificial Sequence: Synthetic peptide
AAINWIAGYTADA

SEQ ID NO: 55 - protein, 13 aa, Artificial Sequence
  Description of Artificial Sequence: Synthetic peptide
AAINWSGGNTYYA

SEQ ID NO: 56 - protein, 13 aa, Artificial Sequence
  Description of Artificial Sequence: Synthetic peptide
AAINWTGGYTPYA

SEQ ID NO: 57 - protein, 13 aa, Artificial Sequence
  Description of Artificial Sequence: Synthetic peptide
AAINWSGGYTAYA

SEQ ID NO: 58 - protein, 13 aa, Artificial Sequence
  Description of Artificial Sequence: Synthetic peptide
GGINWSGGYTYYA

SEQ ID NO: 59 - protein, 13 aa, Artificial Sequence
  Description of Artificial Sequence: Synthetic peptide
AAINWSGGYTHYA

SEQ ID NO: 60 - protein, 13 aa, Artificial Sequence
  Description of Artificial Sequence: Synthetic peptide
AAIHWSGSSTRYA

SEQ ID NO: 61 - protein, 13 aa, Artificial Sequence
  Description of Artificial Sequence: Synthetic peptide
APINWSGGSTYYA

SEQ ID NO: 62 - protein, 13 aa, Artificial Sequence
  Description of Artificial Sequence: Synthetic peptide
AAINWSGGNTPYA

SEQ ID NO: 63 - protein, 13 aa, Artificial Sequence
  Description of Artificial Sequence: Synthetic peptide
AAINWSGDNTHYA

SEQ ID NO: 64 - protein, 13 aa, Artificial Sequence
  Description of Artificial Sequence: Synthetic peptide
AAINWSGGTTRYA

SEQ ID NO: 65 - protein, 13 aa, Artificial Sequence
  Description of Artificial Sequence: Synthetic peptide
AAINWSGDSTYYA

SEQ ID NO: 66 - protein, 13 aa, Artificial Sequence
  Description of Artificial Sequence: Synthetic peptide
AAINWSGGYTYYA

SEQ ID NO: 67 - protein, 13 aa, Artificial Sequence
  Description of Artificial Sequence: Synthetic peptide
AAINWSGGNTDYA

SEQ ID NO: 68 - protein, 13 aa, Artificial Sequence
  Description of Artificial Sequence: Synthetic peptide
AAINWSGGYTPYA

SEQ ID NO: 69 - protein, 13 aa, Artificial Sequence
  Description of Artificial Sequence: Synthetic peptide
AAINWSGGSTYYA

SEQ ID NO: 70 - protein, 13 aa, Artificial Sequence
  Description of Artificial Sequence: Synthetic peptide
AAIHWSAGYTRYA

SEQ ID NO: 71 - protein, 13 aa, Artificial Sequence
  Description of Artificial Sequence: Synthetic peptide
AGMTWSGSSTFYA

SEQ ID NO: 72 - protein, 13 aa, Artificial Sequence
  Description of Artificial Sequence: Synthetic peptide
AAINWSGDNTHYA

SEQ ID NO: 73 - protein, 13 aa, Artificial Sequence
  Description of Artificial Sequence: Synthetic peptide
AGISWNGGSIYYA

SEQ ID NO: 74 - protein, 13 aa, Artificial Sequence
  Description of Artificial Sequence: Synthetic peptide
AAINWSGGTTYYA

SEQ ID NO: 75 - protein, 12 aa, Artificial Sequence
  Description of Artificial Sequence: Synthetic peptide
SAVDSGGSTYYA

SEQ ID NO: 76 - protein, 13 aa, Artificial Sequence
  Description of Artificial Sequence: Synthetic peptide
AAVNWSGGSTYYA

SEQ ID NO: 77 - protein, 13 aa, Artificial Sequence
  Description of Artificial Sequence: Synthetic peptide
AAINWSAGYTAYA

SEQ ID NO: 78 - protein, 13 aa, Artificial Sequence
  Description of Artificial Sequence: Synthetic peptide
AAINWNGGNTHYA

SEQ ID NO: 79 - protein, 13 aa, Artificial Sequence
  Description of Artificial Sequence: Synthetic peptide
AAINWSGGYTYYA

SEQ ID NO: 80 - protein, 13 aa, Artificial Sequence
  Description of Artificial Sequence: Synthetic peptide
AAINWTGGYTYYA

SEQ ID NO: 81 - protein, 13 aa, Artificial Sequence
  Description of Artificial Sequence: Synthetic peptide
AAINWSAGYTAYA

SEQ ID NO: 82 - protein, 13 aa, Artificial Sequence
  Description of Artificial Sequence: Synthetic peptide
AAISWRGGTTYYA

SEQ ID NO: 83 - protein, 13 aa, Artificial Sequence
  Description of Artificial Sequence: Synthetic peptide
AGINWESGSTNYA

SEQ ID NO: 84 - protein, 13 aa, Artificial Sequence
  Description of Artificial Sequence: Synthetic peptide
AAINWSADYTAYA

SEQ ID NO: 85 - protein, 13 aa, Artificial Sequence
  Description of Artificial Sequence: Synthetic peptide
AAITRSGSSTVYA

SEQ ID NO: 86 - protein, 13 aa, Artificial Sequence
  Description of Artificial Sequence: Synthetic peptide
AAINWSAGYTAYA

SEQ ID NO: 87 - protein, 13 aa, Artificial Sequence
  Description of Artificial Sequence: Synthetic peptide
ATINWSGALTHYA

SEQ ID NO: 88 - protein, 13 aa, Artificial Sequence
  Description of Artificial Sequence: Synthetic peptide
AAITWSGGRTRYA

SEQ ID NO: 89 - protein, 13 aa, Artificial Sequence
  Description of Artificial Sequence: Synthetic peptide
ARILWTGASRNYA

SEQ ID NO: 90 - protein, 13 aa, Artificial Sequence
  Description of Artificial Sequence: Synthetic peptide
AGINWSGNGVYYA

SEQ ID NO: 91 - protein, 13 aa, Artificial Sequence
  Description of Artificial Sequence: Synthetic peptide
AAINWSGGTTPYA

SEQ ID NO: 92 - protein, 13 aa, Artificial Sequence
  Description of Artificial Sequence: Synthetic peptide
AAINWSGGYTPYA

SEQ ID NO: 93 - protein, 13 aa, Artificial Sequence
  Description of Artificial Sequence: Synthetic peptide
AAINWSGGSTDYA

SEQ ID NO: 94 - protein, 13 aa, Artificial Sequence
  Description of Artificial Sequence: Synthetic peptide
AAINWSAGYTAYA

SEQ ID NO: 95 - protein, 13 aa, Artificial Sequence
  Description of Artificial Sequence: Synthetic peptide
AAINWSGGSTRYA

SEQ ID NO: 96 - protein, 13 aa, Artificial Sequence
  Description of Artificial Sequence: Synthetic peptide
AAINWSAGYTPYA

SEQ ID NO: 97 - protein, 13 aa, Artificial Sequence
  Description of Artificial Sequence: Synthetic peptide
AAINWNAGYTAYA

SEQ ID NO: 98 - protein, 13 aa, Artificial Sequence
  Description of Artificial Sequence: Synthetic peptide
GRINWSGGNTYYA

SEQ ID NO: 99 - protein, 13 aa, Artificial Sequence
  Description of Artificial Sequence: Synthetic peptide
AAINWSAGYTAYA

SEQ ID NO: 100 - protein, 13 aa, Artificial Sequence
  Description of Artificial Sequence: Synthetic peptide
AVVNWSGRRTYYA

SEQ ID NO: 101 - protein, 9 aa, Artificial Sequence
  Description of Artificial Sequence: Synthetic peptide
CATDPPLFW

SEQ ID NO: 102 - protein, 15 aa, Artificial Sequence
  Description of Artificial Sequence: Synthetic peptide
CARASPNTGWHFDRW

SEQ ID NO: 103 - protein, 9 aa, Artificial Sequence
  Description of Artificial Sequence: Synthetic peptide
CATDPPLFW

SEQ ID NO: 104 - protein, 15 aa, Artificial Sequence
  Description of Artificial Sequence: Synthetic peptide
CAEPSPNTGWHFDHW

SEQ ID NO: 105 - protein, 9 aa, Artificial Sequence
  Description of Artificial Sequence: Synthetic peptide
CATDPPLFW

SEQ ID NO: 106 - protein, 9 aa, Artificial Sequence
  Description of Artificial Sequence: Synthetic peptide
CATDPPLFW

SEQ ID NO: 107 - protein, 15 aa, Artificial Sequence
  Description of Artificial Sequence: Synthetic peptide
CATASPNTGWHFDHW

SEQ ID NO: 108 - protein, 9 aa, Artificial Sequence
  Description of Artificial Sequence: Synthetic peptide
CATDPPLFW

SEQ ID NO: 109 - protein, 9 aa, Artificial Sequence
  Description of Artificial Sequence: Synthetic peptide
CATDPPLFW

SEQ ID NO: 110 - protein, 9 aa, Artificial Sequence
  Description of Artificial Sequence: Synthetic peptide
CATDPPLFW

SEQ ID NO: 111 - protein, 9 aa, Artificial Sequence
  Description of Artificial Sequence: Synthetic peptide
CATDPPLFW

SEQ ID NO: 112 - protein, 9 aa, Artificial Sequence
  Description of Artificial Sequence: Synthetic peptide
CATDPPLFW

SEQ ID NO: 113 - protein, 9 aa, Artificial Sequence
  Description of Artificial Sequence: Synthetic peptide
CATDPPLFW

SEQ ID NO: 114 - protein, 9 aa, Artificial Sequence
  Description of Artificial Sequence: Synthetic peptide
CATDPPLFW

SEQ ID NO: 115 - protein, 9 aa, Artificial Sequence
  Description of Artificial Sequence: Synthetic peptide
CATDPPLFW

SEQ ID NO: 116 - protein, 9 aa, Artificial Sequence
  Description of Artificial Sequence: Synthetic peptide
CATDPPLFW

SEQ ID NO: 117 - protein, 9 aa, Artificial Sequence
  Description of Artificial Sequence: Synthetic peptide
CATDPPLFW

SEQ ID NO: 118 - protein, 9 aa, Artificial Sequence
  Description of Artificial Sequence: Synthetic peptide
CATDPPLFW

SEQ ID NO: 119 - protein, 9 aa, Artificial Sequence
  Description of Artificial Sequence: Synthetic peptide
CATDPPLFW

SEQ ID NO: 120 - protein, 15 aa, Artificial Sequence
  Description of Artificial Sequence: Synthetic peptide
CATDPPLFWGHVDLW

SEQ ID NO: 121 - protein, 9 aa, Artificial Sequence
  Description of Artificial Sequence: Synthetic peptide
CATDPPLFW

SEQ ID NO: 122 - protein, 9 aa, Artificial Sequence
  Description of Artificial Sequence: Synthetic peptide
CATDPPLFW

SEQ ID NO: 123 - protein, 9 aa, Artificial Sequence
  Description of Artificial Sequence: Synthetic peptide
CATDPPLFW

SEQ ID NO: 124 - protein, 9 aa, Artificial Sequence
  Description of Artificial Sequence: Synthetic peptide
CATDPPLFW

SEQ ID NO: 125 - protein, 13 aa, Artificial Sequence
  Description of Artificial Sequence: Synthetic peptide
CAASPSLRSAWQW

SEQ ID NO: 126 - protein, 9 aa, Artificial Sequence
  Description of Artificial Sequence: Synthetic peptide
CATDPPLFW

SEQ ID NO: 127 - protein, 15 aa, Artificial Sequence
  Description of Artificial Sequence: Synthetic peptide
CARATPNTGWHFDHW

SEQ ID NO: 128 - protein, 9 aa, Artificial Sequence
  Description of Artificial Sequence: Synthetic peptide
CATDPPLFW

SEQ ID NO: 129 - protein, 9 aa, Artificial Sequence
  Description of Artificial Sequence: Synthetic peptide
CATDPPLFW

SEQ ID NO: 130 - protein, 9 aa, Artificial Sequence
  Description of Artificial Sequence: Synthetic peptide
CATDPPLFW

SEQ ID NO: 131 - protein, 15 aa, Artificial Sequence
  Description of Artificial Sequence: Synthetic peptide
CATASPNTGWHFDHW

SEQ ID NO: 132 - protein, 18 aa, Artificial Sequence
  Description of Artificial Sequence: Synthetic peptide
CAADRRGLASTRAGDYDW

SEQ ID NO: 133 - protein, 20 aa, Artificial Sequence
  Description of Artificial Sequence: Synthetic peptide
CAADRGVYGGRWYRTSQYTW

SEQ ID NO: 134 - protein, 15 aa, Artificial Sequence
  Description of Artificial Sequence: Synthetic peptide
CATDPPLFCWHFDHW

SEQ ID NO: 135 - protein, 11 aa, Artificial Sequence
  Description of Artificial Sequence: Synthetic peptide
CATTMNPNPRW

SEQ ID NO: 136 - protein, 15 aa, Artificial Sequence
  Description of Artificial Sequence: Synthetic peptide
CATAPPLFCWHFDHW

SEQ ID NO: 137 - protein, 23 aa, Artificial Sequence
  Description of Artificial Sequence: Synthetic peptide
CATLPFYDFWSGYYTGYYYMDVW

SEQ ID NO: 138 - protein, 9 aa, Artificial Sequence
  Description of Artificial Sequence: Synthetic peptide
CATDRPLFW

SEQ ID NO: 139 - protein, 11 aa, Artificial Sequence
  Description of Artificial Sequence: Synthetic peptide
CATTENPNPRW

SEQ ID NO: 140 - protein, 9 aa, Artificial Sequence
  Description of Artificial Sequence: Synthetic peptide
CATDPPLFW

SEQ ID NO: 141 - protein, 15 aa, Artificial Sequence
  Description of Artificial Sequence: Synthetic peptide
CATDPPLFCCHVDLW

SEQ ID NO: 142 - protein, 15 aa, Artificial Sequence
  Description of Artificial Sequence: Synthetic peptide
CATDPPLFWGHVDLW

SEQ ID NO: 143 - protein, 9 aa, Artificial Sequence
  Description of Artificial Sequence: Synthetic peptide
CATDPPLFW

SEQ ID NO: 144 - protein, 15 aa, Artificial Sequence
  Description of Artificial Sequence: Synthetic peptide
CATARPNTGWHFDHW

SEQ ID NO: 145 - protein, 9 aa, Artificial Sequence
  Description of Artificial Sequence: Synthetic peptide
CATDPPLFW

SEQ ID NO: 146 - protein, 15 aa, Artificial Sequence
  Description of Artificial Sequence: Synthetic peptide
CATDPPLFWGHVDLW

SEQ ID NO: 147 - protein, 15 aa, Artificial Sequence
  Description of Artificial Sequence: Synthetic peptide
CAKASPNTGWHFDHW

SEQ ID NO: 148 - protein, 9 aa, Artificial Sequence
  Description of Artificial Sequence: Synthetic peptide
CATDPPLFW

SEQ ID NO: 149 - protein, 15 aa, Artificial Sequence
  Description of Artificial Sequence: Synthetic peptide
CARASPNTGWHFDHW

SEQ ID NO: 150 - protein, 13 aa, Artificial Sequence
  Description of Artificial Sequence: Synthetic peptide
CAVPWMDYNRRDW

SEQ ID NO: 151 - protein, 9 aa, Artificial Sequence
  Description of Artificial Sequence: Synthetic peptide
FTFSNYATD

SEQ ID NO: 152 - protein, 9 aa, Artificial Sequence
  Description of Artificial Sequence: Synthetic peptide
FTFSRHAMN

SEQ ID NO: 153 - protein, 9 aa, Artificial Sequence
  Description of Artificial Sequence: Synthetic peptide
FTFSDFAMA

SEQ ID NO: 154 - protein, 9 aa, Artificial Sequence
  Description of Artificial Sequence: Synthetic peptide
FTFSDFAMA

SEQ ID NO: 155 - protein, 9 aa, Artificial Sequence
  Description of Artificial Sequence: Synthetic peptide
FTFSDFAMA

SEQ ID NO: 156 - protein, 9 aa, Artificial Sequence
  Description of Artificial Sequence: Synthetic peptide
FTFSDFAMA

SEQ ID NO: 157 - protein, 9 aa, Artificial Sequence
  Description of Artificial Sequence: Synthetic peptide
FTFSDFAMA

SEQ ID NO: 158 - protein, 9 aa, Artificial Sequence
  Description of Artificial Sequence: Synthetic peptide
FTFSDFAMA

SEQ ID NO: 159 - protein, 9 aa, Artificial Sequence
  Description of Artificial Sequence: Synthetic peptide
FTFPRYAMS

SEQ ID NO: 160 - protein, 9 aa, Artificial Sequence
  Description of Artificial Sequence: Synthetic peptide
FTFSAFAMG

SEQ ID NO: 161 - protein, 9 aa, Artificial Sequence
  Description of Artificial Sequence: Synthetic peptide
FTFSNYPMN

SEQ ID NO: 162 - protein, 9 aa, Artificial Sequence
  Description of Artificial Sequence: Synthetic peptide
FTFSDYPMN

SEQ ID NO: 163 - protein, 9 aa, Artificial Sequence
  Description of Artificial Sequence: Synthetic peptide
FTFSDYPMN

SEQ ID NO: 164 - protein, 9 aa, Artificial Sequence
  Description of Artificial Sequence: Synthetic peptide
FTFSDYPMN

SEQ ID NO: 165 - protein, 9 aa, Artificial Sequence
  Description of Artificial Sequence: Synthetic peptide
FTFSDYPMN

SEQ ID NO: 166 - protein, 13 aa, Artificial Sequence
  Description of Artificial Sequence: Synthetic peptide
SIISGSGGATYYA

SEQ ID NO: 167 - protein, 13 aa, Artificial Sequence
  Description of Artificial Sequence: Synthetic peptide
SGISGSGDETYYA

SEQ ID NO: 168 - protein, 13 aa, Artificial Sequence
  Description of Artificial Sequence: Synthetic peptide
SAISGSGDITYYA

SEQ ID NO: 169 - protein, 13 aa, Artificial Sequence
  Description of Artificial Sequence: Synthetic peptide
SAITGTGDITYYA

SEQ ID NO: 170 - protein, 13 aa, Artificial Sequence
  Description of Artificial Sequence: Synthetic peptide
SAISGSGDITYYA

SEQ ID NO: 171 - protein, 13 aa, Artificial Sequence
  Description of Artificial Sequence: Synthetic peptide
SAISGSGDITYYA

SEQ ID NO: 172 - protein, 13 aa, Artificial Sequence
  Description of Artificial Sequence: Synthetic peptide
SAITGSGDITYYA

SEQ ID NO: 173 - protein, 13 aa, Artificial Sequence
  Description of Artificial Sequence: Synthetic peptide
SAISGSGDITYYA

SEQ ID NO: 174 - protein, 13 aa, Artificial Sequence
  Description of Artificial Sequence: Synthetic peptide
STISGSGSTTYYA

SEQ ID NO: 175 - protein, 13 aa, Artificial Sequence
  Description of Artificial Sequence: Synthetic peptide
SAITASGDITYYA

SEQ ID NO: 176 - protein, 13 aa, Artificial Sequence
  Description of Artificial Sequence: Synthetic peptide
STISGSGGNTFYA

SEQ ID NO: 177 - protein, 13 aa, Artificial Sequence
  Description of Artificial Sequence: Synthetic peptide
STISGSGGITFYA

SEQ ID NO: 178 - protein, 13 aa, Artificial Sequence
  Description of Artificial Sequence: Synthetic peptide
SAISGSGDNTYYA

SEQ ID NO: 179 - protein, 13 aa, Artificial Sequence
  Description of Artificial Sequence: Synthetic peptide
SAITGSGDITYYA

SEQ ID NO: 180 - protein, 13 aa, Artificial Sequence
  Description of Artificial Sequence: Synthetic peptide
STISGSGGITFYA

SEQ ID NO: 181 - protein, 21 aa, Artificial Sequence
  Description of Artificial Sequence: Synthetic peptide
CAKGGYCSSDTCWWEYWLDPW

SEQ ID NO: 182 - protein, 24 aa, Artificial Sequence
  Description of Artificial Sequence: Synthetic peptide
CARDLPASYYDSSGYYWHNGMDVW

SEQ ID NO: 183 - protein, 17 aa, Artificial Sequence
  Description of Artificial Sequence: Synthetic peptide
CAREADCLPSPWYLDLW

SEQ ID NO: 184 - protein, 12 aa, Artificial Sequence
  Description of Artificial Sequence: Synthetic peptide
CAREADGLHSPW

SEQ ID NO: 185 - protein, 17 aa, Artificial Sequence
  Description of Artificial Sequence: Synthetic peptide
CAREADGLHSPWHFDLW

SEQ ID NO: 186 - protein, 17 aa, Artificial Sequence
  Description of Artificial Sequence: Synthetic peptide
CAREADGLHSPWHFDLW

SEQ ID NO: 187 - protein, 17 aa, Artificial Sequence
  Description of Artificial Sequence: Synthetic peptide
CAREADGLHSPWHFDLW

SEQ ID NO: 188 - protein, 17 aa, Artificial Sequence
  Description of Artificial Sequence: Synthetic peptide
CAREADGLHSPWHFDLW

SEQ ID NO: 189 - protein, 11 aa, Artificial Sequence
  Description of Artificial Sequence: Synthetic peptide
CARLIDAFDIW

SEQ ID NO: 190 - protein, 17 aa, Artificial Sequence
  Description of Artificial Sequence: Synthetic peptide
CARQSDGLPSPWHFDLG

SEQ ID NO: 191 - protein, 12 aa, Artificial Sequence
  Description of Artificial Sequence: Synthetic peptide
CVRHDEYSFDYW

SEQ ID NO: 192 - protein, 12 aa, Artificial Sequence
  Description of Artificial Sequence: Synthetic peptide
CVRHDEYSFDYW

SEQ ID NO: 193 - protein, 12 aa, Artificial Sequence
  Description of Artificial Sequence: Synthetic peptide
CVRHDEYSFDYW

SEQ ID NO: 194 - protein, 12 aa, Artificial Sequence
  Description of Artificial Sequence: Synthetic peptide
CVRHDEYSFDYW

SEQ ID NO: 195 - protein, 12 aa, Artificial Sequence
  Description of Artificial Sequence: Synthetic peptide
CVRHDEYSFDYW

SEQ ID NO: 196 - protein, 11 aa, Artificial Sequence
  Description of Artificial Sequence: Synthetic peptide
RASQSIHRFLN

SEQ ID NO: 197 - protein, 11 aa, Artificial Sequence
  Description of Artificial Sequence: Synthetic peptide
RASQTINTYLN

SEQ ID NO: 198 - protein, 11 aa, Artificial Sequence
  Description of Artificial Sequence: Synthetic peptide
RASQNIHTYLN

SEQ ID NO: 199 - protein, 11 aa, Artificial Sequence
  Description of Artificial Sequence: Synthetic peptide
RASQSIDTYLN

SEQ ID NO: 200 - protein, 11 aa, Artificial Sequence
  Description of Artificial Sequence: Synthetic peptide
RASQSIHTYLN

SEQ ID NO: 201 - protein, 11 aa, Artificial Sequence
  Description of Artificial Sequence: Synthetic peptide
RASQSIDTYLN

SEQ ID NO: 202 - protein, 11 aa, Artificial Sequence
  Description of Artificial Sequence: Synthetic peptide
RASQSIDTYLN

SEQ ID NO: 203 - protein, 11 aa, Artificial Sequence
  Description of Artificial Sequence: Synthetic peptide
RASQSIDTYLN

SEQ ID NO: 204 - protein, 11 aa, Artificial Sequence
  Description of Artificial Sequence: Synthetic peptide
RASQRIGTYLN

SEQ ID NO: 205 - protein, 11 aa, Artificial Sequence
  Description of Artificial Sequence: Synthetic peptide
RASQSIHISLN

SEQ ID NO: 206 - protein, 11 aa, Artificial Sequence
  Description of Artificial Sequence: Synthetic peptide
RASQSIGNYLN

SEQ ID NO: 207 - protein, 11 aa, Artificial Sequence
  Description of Artificial Sequence: Synthetic peptide
RASQSIDNYLN

SEQ ID NO: 208 - protein, 11 aa, Artificial Sequence
  Description of Artificial Sequence: Synthetic peptide
RASQSIDTYLN

SEQ ID NO: 209 - protein, 11 aa, Artificial Sequence
  Description of Artificial Sequence: Synthetic peptide
RASQSIDTYLN

SEQ ID NO: 210 - protein, 11 aa, Artificial Sequence
  Description of Artificial Sequence: Synthetic peptide
RASQSIDNYLN

SEQ ID NO: 211 - protein, 7 aa, Artificial Sequence
  Description of Artificial Sequence: Synthetic peptide
AASNLHS

SEQ ID NO: 212 - protein, 7 aa, Artificial Sequence
  Description of Artificial Sequence: Synthetic peptide
SASTLQS

SEQ ID NO: 213 - protein, 7 aa, Artificial Sequence
  Description of Artificial Sequence: Synthetic peptide
AASTFAK

SEQ ID NO: 214 - protein, 7 aa, Artificial Sequence
  Description of Artificial Sequence: Synthetic peptide
AASALAS

SEQ ID NO: 215 - protein, 7 aa, Artificial Sequence
  Description of Artificial Sequence: Synthetic peptide
AASALAS

SEQ ID NO: 216 - protein, 7 aa, Artificial Sequence
  Description of Artificial Sequence: Synthetic peptide
AASALAS

SEQ ID NO: 217 - protein, 7 aa, Artificial Sequence
  Description of Artificial Sequence: Synthetic peptide
AASALAS

SEQ ID NO: 218 - protein, 7 aa, Artificial Sequence
  Description of Artificial Sequence: Synthetic peptide
AASALAS

SEQ ID NO: 219 - protein, 7 aa, Artificial Sequence
  Description of Artificial Sequence: Synthetic peptide
AASNLEG

SEQ ID NO: 220 - protein, 7 aa, Artificial Sequence
  Description of Artificial Sequence: Synthetic peptide
LASPLAS

SEQ ID NO: 221 - protein, 7 aa, Artificial Sequence
  Description of Artificial Sequence: Synthetic peptide
GVSSLQS

SEQ ID NO: 222 - protein, 7 aa, Artificial Sequence
  Description of Artificial Sequence: Synthetic peptide
GVSALQS

SEQ ID NO: 223 - protein, 7 aa, Artificial Sequence
  Description of Artificial Sequence: Synthetic peptide
GASALES

SEQ ID NO: 224 - protein, 7 aa, Artificial Sequence
  Description of Artificial Sequence: Synthetic peptide
GVSALQS

SEQ ID NO: 225 - protein, 7 aa, Artificial Sequence
  Description of Artificial Sequence: Synthetic peptide
GVSALQS

SEQ ID NO: 226 - protein, 11 aa, Artificial Sequence
  Description of Artificial Sequence: Synthetic peptide
CQQSYGLPPTF

SEQ ID NO: 227 - protein, 10 aa, Artificial Sequence [sequence omitted]

SEQ ID NO: 228 - protein, 12 aa, Artificial Sequence [sequence omitted]

SEQ ID NO: 229 - protein, 12 aa, Artificial Sequence [sequence omitted]

SEQ ID NO: 230 - protein, 12 aa, Artificial Sequence [sequence omitted]

SEQ ID NO: 231 - protein, 12 aa, Artificial Sequence [sequence omitted]

SEQ ID NO: 232 - protein, 12 aa, Artificial Sequence [sequence omitted]

SEQ ID NO: 233 - protein, 12 aa, Artificial Sequence [sequence omitted]

SEQ ID NO: 234 - protein, 11 aa, Artificial Sequence
  Description of Artificial Sequence: Synthetic peptide
CQQNYSTTWTF

SEQ ID NO: 235 - protein, 12 aa, Artificial Sequence [sequence omitted]

SEQ ID NO: 236 - protein, 11 aa, Artificial Sequence [sequence omitted]

SEQ ID NO: 237 - protein, 12 aa, Artificial Sequence
  Description of Artificial Sequence: Synthetic peptide
CQQSHSAPPYFF

SEQ ID NO: 238 - protein, 12 aa, Artificial Sequence
  Description of Artificial Sequence: Synthetic peptide
CQQSHSAPPYFF

SEQ ID NO: 239 - protein, 12 aa, Artificial Sequence
  Description of Artificial Sequence: Synthetic peptide
CQQSYSAPPYFF

SEQ ID NO: 240 - protein, 11 aa, Artificial Sequence [sequence omitted]

SEQ ID NO: 241 - protein, 9 aa, Artificial Sequence
  Description of Artificial Sequence: Synthetic peptide
FMFGNYAMS

SEQ ID NO: 242 - protein, 9 aa, Artificial Sequence
  Description of Artificial Sequence: Synthetic peptide
FTFRSHAMN

SEQ ID NO: 243 - protein, 9 aa, Artificial Sequence
  Description of Artificial Sequence: Synthetic peptide
FTFRNYAMA

SEQ ID NO: 244 - protein, 9 aa, Artificial Sequence
  Description of Artificial Sequence: Synthetic peptide
FTFRNHAMA

SEQ ID NO: 245 - protein, 9 aa, Artificial Sequence
  Description of Artificial Sequence: Synthetic peptide
FTITNYAMS

SEQ ID NO: 246 - protein, 9 aa, Artificial Sequence
  Description of Artificial Sequence: Synthetic peptide
FTIPNYAMS

SEQ ID NO: 247 - protein, 9 aa, Artificial Sequence
  Description of Artificial Sequence: Synthetic peptide
FTIPNYAMS

SEQ ID NO: 248 - protein, 9 aa, Artificial Sequence
  Description of Artificial Sequence: Synthetic peptide
FTITNYAMS

SEQ ID NO: 249 - protein, 9 aa, Artificial Sequence
  Description of Artificial Sequence: Synthetic peptide
FTITNYAMS

SEQ ID NO: 250 - protein, 9 aa, Artificial Sequence
  Description of Artificial Sequence: Synthetic peptide
FTFRSHAMS

SEQ ID NO: 251 - protein, 9 aa, Artificial Sequence
  Description of Artificial Sequence: Synthetic peptide
FTIRNYAMS

SEQ ID NO: 252 - protein, 9 aa, Artificial Sequence
  Description of Artificial Sequence: Synthetic peptide
FTFRSHAMS

SEQ ID NO: 253 - protein, 9 aa, Artificial Sequence
  Description of Artificial Sequence: Synthetic peptide
FTFRSHAMS

SEQ ID NO: 254 - protein, 9 aa, Artificial Sequence
  Description of Artificial Sequence: Synthetic peptide
FTFRSYAMS

SEQ ID NO: 255 - protein, 9 aa, Artificial Sequence
  Description of Artificial Sequence: Synthetic peptide
FTFSAYSMS

SEQ ID NO: 256 - protein, 13 aa, Artificial Sequence
  Description of Artificial Sequence: Synthetic peptide
AAISGSGGSTYYA

SEQ ID NO: 257 - protein, 13 aa, Artificial Sequence
  Description of Artificial Sequence: Synthetic peptide
SAISGSGGSTNYA

SEQ ID NO: 258 - protein, 13 aa, Artificial Sequence
  Description of Artificial Sequence: Synthetic peptide
SGISGSGGTTYYG

SEQ ID NO: 259 - protein, 13 aa, Artificial Sequence
  Description of Artificial Sequence: Synthetic peptide
SGISGSGGTTYYG

SEQ ID NO: 260 - protein, 13 aa, Artificial Sequence
  Description of Artificial Sequence: Synthetic peptide
SGISGSGAGTYYA

SEQ ID NO: 261 - protein, 13 aa, Artificial Sequence
  Description of Artificial Sequence: Synthetic peptide
SGISGAGASTYYA

SEQ ID NO: 262 - protein, 13 aa, Artificial Sequence
  Description of Artificial Sequence: Synthetic peptide
SGISGSGASTYYA

SEQ ID NO: 263 - protein, 13 aa, Artificial Sequence
  Description of Artificial Sequence: Synthetic peptide
SGISGSGASTYYA

SEQ ID NO: 264 - protein, 13 aa, Artificial Sequence
  Description of Artificial Sequence: Synthetic peptide
SGISGSGAGTYYA

SEQ ID NO: 265 - protein, 13 aa, Artificial Sequence
  Description of Artificial Sequence: Synthetic peptide
SSISGGGASTYYA

SEQ ID NO: 266 - protein, 13 aa, Artificial Sequence
  Description of Artificial Sequence: Synthetic peptide
SSISGGGASTYYA

SEQ ID NO: 267 - protein, 13 aa, Artificial Sequence
  Description of Artificial Sequence: Synthetic peptide
SSISGGGASTYYA

SEQ ID NO: 268 - protein, 13 aa, Artificial Sequence
  Description of Artificial Sequence: Synthetic peptide
SSISGGGASTYYA

SEQ ID NO: 269 - protein, 13 aa, Artificial Sequence
  Description of Artificial Sequence: Synthetic peptide
SSISGGGASTYYA

SEQ ID NO: 270 - protein, 13 aa, Artificial Sequence
  Description of Artificial Sequence: Synthetic peptide
SAISGSGGSRYYA

SEQ ID NO: 271 - protein, 18 aa, Artificial Sequence
  Description of Artificial Sequence: Synthetic peptide
CAKDRGYSSSWYGGFDYW

SEQ ID NO: 272 - protein, 18 aa, Artificial Sequence
  Description of Artificial Sequence: Synthetic peptide
CARGLKFLEWLPSAFDIW

SEQ ID NO: 273 - protein, 17 aa, Artificial Sequence
  Description of Artificial Sequence: Synthetic peptide
CARGTRFLEWSLPLDVW

SEQ ID NO: 274 - protein, 17 aa, Artificial Sequence
  Description of Artificial Sequence: Synthetic peptide
CARGTRFLQWSLPLDVW

SEQ ID NO: 275 - protein, 16 aa, Artificial Sequence
  Description of Artificial Sequence: Synthetic peptide
CARHAWWKGAGFFDHW

SEQ ID NO: 276 - protein, 16 aa, Artificial Sequence
  Description of Artificial Sequence: Synthetic peptide
CARHTWWKGAGFFDHW

SEQ ID NO: 277 - protein, 16 aa, Artificial Sequence
  Description of Artificial Sequence: Synthetic peptide
CARHTWWKGAGFFDHW

SEQ ID NO: 278 - protein, 16 aa, Artificial Sequence
  Description of Artificial Sequence: Synthetic peptide
CARHTWWKGAGFFDHW

SEQ ID NO: 279 - protein, 16 aa, Artificial Sequence
  Description of Artificial Sequence: Synthetic peptide
CARHTWWKGAGFFDHW

SEQ ID NO: 280 - protein, 21 aa, Artificial Sequence
  Description of Artificial Sequence: Synthetic peptide
CARVKYLTTSSGWPRPYFDNW

SEQ ID NO: 281 - protein, 21 aa, Artificial Sequence
  Description of Artificial Sequence: Synthetic peptide
CARVKYLTTSSGWPRPYFDNW

SEQ ID NO: 282 - protein, 21 aa, Artificial Sequence
  Description of Artificial Sequence: Synthetic peptide
CARVKYLTTSSGWPRPYFDNW

SEQ ID NO: 283 - protein, 21 aa, Artificial Sequence
  Description of Artificial Sequence: Synthetic peptide
CARVKYLTTSSGWPRPYFDNW

SEQ ID NO: 284 - protein, 21 aa, Artificial Sequence
  Description of Artificial Sequence: Synthetic peptide
CARVKYLTTSSGWPRPYFDNW

SEQ ID NO: 285 - protein, 16 aa, Artificial Sequence
  Description of Artificial Sequence: Synthetic peptide
CGRSKWPQANGAFDIW

SEQ ID NO: 286 - protein, 11 aa, Artificial Sequence
  Description of Artificial Sequence: Synthetic peptide
RASQTIYSYLN

SEQ ID NO: 287 - protein, 11 aa, Artificial Sequence
  Description of Artificial Sequence: Synthetic peptide
RTSQSINTYLN

SEQ ID NO: 288 - protein, 11 aa, Artificial Sequence
  Description of Artificial Sequence: Synthetic peptide
RASRSISRYLN

SEQ ID NO: 289 - protein, 11 aa, Artificial Sequence
  Description of Artificial Sequence: Synthetic peptide
RASRSIRRYLN

SEQ ID NO: 290 - protein, 11 aa, Artificial Sequence
  Description of Artificial Sequence: Synthetic peptide
RASQSIGRYLN

SEQ ID NO: 291 - protein, 11 aa, Artificial Sequence
  Description of Artificial Sequence: Synthetic peptide
RASQSIGKYLN

SEQ ID NO: 292 - protein, 11 aa, Artificial Sequence
  Description of Artificial Sequence: Synthetic peptide
RASQSIGRYLN

SEQ ID NO: 293 - protein, 11 aa, Artificial Sequence
  Description of Artificial Sequence: Synthetic peptide
RASQSIGRYLN

SEQ ID NO: 294 - protein, 11 aa, Artificial Sequence
  Description of Artificial Sequence: Synthetic peptide
RASQSIGRYLN

SEQ ID NO: 295 - protein, 11 aa, Artificial Sequence
  Description of Artificial Sequence: Synthetic peptide
RASQSIRKYLN

SEQ ID NO: 296 - protein, 11 aa, Artificial Sequence
  Description of Artificial Sequence: Synthetic peptide
RASQSIGKYLN

SEQ ID NO: 297 - protein, 11 aa, Artificial Sequence
  Description of Artificial Sequence: Synthetic peptide
RASQSIGKYLN

SEQ ID NO: 298 - protein, 11 aa, Artificial Sequence
  Description of Artificial Sequence: Synthetic peptide
RASQSIGKYLN

SEQ ID NO: 299 - protein, 11 aa, Artificial Sequence
  Description of Artificial Sequence: Synthetic peptide
RASQSIGKYLN

SEQ ID NO: 300 - protein, 11 aa, Artificial Sequence
  Description of Artificial Sequence: Synthetic peptide
RASQNIKTYLN

SEQ ID NO: 301 - protein, 7 aa, Artificial Sequence
  Description of Artificial Sequence: Synthetic peptide
ATSTLQG

SEQ ID NO: 302 - protein, 7 aa, Artificial Sequence
  Description of Artificial Sequence: Synthetic peptide
GASNVQS

SEQ ID NO: 303 - protein, 7 aa, Artificial Sequence
  Description of Artificial Sequence: Synthetic peptide
AASSLQA

SEQ ID NO: 304 - protein, 7 aa, Artificial Sequence
  Description of Artificial Sequence: Synthetic peptide
ASSSLQA

SEQ ID NO: 305 - protein, 7 aa, Artificial Sequence
  Description of Artificial Sequence: Synthetic peptide
AASSLKS

SEQ ID NO: 306 - protein, 7 aa, Artificial Sequence
  Description of Artificial Sequence: Synthetic peptide
ASSSLQS

SEQ ID NO: 307 - protein, 7 aa, Artificial Sequence
  Description of Artificial Sequence: Synthetic peptide
ASSSLQS

SEQ ID NO: 308 - protein, 7 aa, Artificial Sequence
  Description of Artificial Sequence: Synthetic peptide
AASSLKS

SEQ ID NO: 309 - protein, 7 aa, Artificial Sequence
  Description of Artificial Sequence: Synthetic peptide
AASSLKS

SEQ ID NO: 310 - protein, 7 aa, Artificial Sequence
  Description of Artificial Sequence: Synthetic peptide
ASSTLQR

SEQ ID NO: 311 - protein, 7 aa, Artificial Sequence
  Description of Artificial Sequence: Synthetic peptide
ASSTLQR

SEQ ID NO: 312 - protein, 7 aa, Artificial Sequence
  Description of Artificial Sequence: Synthetic peptide
ASSTLQR

SEQ ID NO: 313 - protein, 7 aa, Artificial Sequence
  Description of Artificial Sequence: Synthetic peptide
ASSTLQR

SEQ ID NO: 314 - protein, 7 aa, Artificial Sequence
  Description of Artificial Sequence: Synthetic peptide
ASSTLQR

SEQ ID NO: 315 - protein, 7 aa, Artificial Sequence
  Description of Artificial Sequence: Synthetic peptide
AASKLQS

SEQ ID NO: 316 - protein, 7 aa, Artificial Sequence [sequence omitted]

SEQ ID NO: 317 - protein, 11 aa, Artificial Sequence [sequence omitted]

SEQ ID NO: 318 - protein, 11 aa, Artificial Sequence [sequence omitted]

SEQ ID NO: 319 - protein, 11 aa, Artificial Sequence [sequence omitted]

SEQ ID NO: 320 - protein, 11 aa, Artificial Sequence [sequence omitted]

SEQ ID NO: 321 - protein, 11 aa, Artificial Sequence [sequence omitted]

SEQ ID NO: 322 - protein, 11 aa, Artificial Sequence [sequence omitted]

SEQ ID NO: 323 - protein, 11 aa, Artificial Sequence [sequence omitted]

SEQ ID NO: 324 - protein, 11 aa, Artificial Sequence [sequence omitted]

SEQ ID NO: 325 - protein, 11 aa, Artificial Sequence [sequence omitted]

SEQ ID NO: 326 - protein, 11 aa, Artificial Sequence
  Description of Artificial Sequence: Synthetic peptide
CQQSLSPPFTF

SEQ ID NO: 327 - protein, 11 aa, Artificial Sequence [sequence omitted]

SEQ ID NO: 328 - protein, 11 aa, Artificial Sequence
  Description of Artificial Sequence: Synthetic peptide
CQQSFSPPFTF

SEQ ID NO: 329 - protein, 11 aa, Artificial Sequence [sequence omitted]

SEQ ID NO: 330 - protein, 11 aa, Artificial Sequence [sequence omitted]

SEQ ID NO: 331 - protein, 9 aa, Artificial Sequence
  Description of Artificial Sequence: Synthetic peptide
FTFSNYATD

SEQ ID NO: 332 - protein, 9 aa, Artificial Sequence
  Description of Artificial Sequence: Synthetic peptide
FTFSAFAMG

SEQ ID NO: 333 - protein, 9 aa, Artificial Sequence
  Description of Artificial Sequence: Synthetic peptide
FTFSDFAMA

SEQ ID NO: 334 - protein, 9 aa, Artificial Sequence
  Description of Artificial Sequence: Synthetic peptide
FTFSRHAMN

SEQ ID NO: 335 - protein, 9 aa, Artificial Sequence
  Description of Artificial Sequence: Synthetic peptide
FTFSDFAMA

SEQ ID NO: 336 - protein, 9 aa, Artificial Sequence
  Description of Artificial Sequence: Synthetic peptide
FTFSNYPMN

SEQ ID NO: 337 - protein, 9 aa, Artificial Sequence
  Description of Artificial Sequence: Synthetic peptide
FTFSDFAMA

SEQ ID NO: 338 - protein, 9 aa, Artificial Sequence
  Description of Artificial Sequence: Synthetic peptide
FTFSDYPMN

SEQ ID NO: 339 - protein, 9 aa, Artificial Sequence
  Description of Artificial Sequence: Synthetic peptide
FTFSDYPMN

SEQ ID NO: 340 - protein, 9 aa, Artificial Sequence
  Description of Artificial Sequence: Synthetic peptide
FTFSDFAMA

SEQ ID NO: 341 - protein, 9 aa, Artificial Sequence
  Description of Artificial Sequence: Synthetic peptide
FTFSDYPMN

SEQ ID NO: 342 - protein, 9 aa, Artificial Sequence
  Description of Artificial Sequence: Synthetic peptide
FTFSDFAMA

SEQ ID NO: 343 - protein, 9 aa, Artificial Sequence
  Description of Artificial Sequence: Synthetic peptide
FTFSDFAMA

SEQ ID NO: 344 - protein, 9 aa, Artificial Sequence
  Description of Artificial Sequence: Synthetic peptide
FTFPRYAMS

SEQ ID NO: 345 - protein, 9 aa, Artificial Sequence
  Description of Artificial Sequence: Synthetic peptide
FTFSSYAMS

SEQ ID NO: 346 - protein, 9 aa, Artificial Sequence
  Description of Artificial Sequence: Synthetic peptide
FTFSNYAMS

SEQ ID NO: 347 - protein, 9 aa, Artificial Sequence
  Description of Artificial Sequence: Synthetic peptide
FTFSSYAMY

SEQ ID NO: 348 - protein, 9 aa, Artificial Sequence
  Description of Artificial Sequence: Synthetic peptide
FTFSSYTMS

SEQ ID NO: 349 - protein, 9 aa, Artificial Sequence
  Description of Artificial Sequence: Synthetic peptide
FTFSSYDMS

SEQ ID NO: 350 - protein, 9 aa, Artificial Sequence
  Description of Artificial Sequence: Synthetic peptide
FTFPRYAMS

SEQ ID NO: 351 - protein, 9 aa, Artificial Sequence
  Description of Artificial Sequence: Synthetic peptide
FTFTTYALS

SEQ ID NO: 352 - protein, 9 aa, Artificial Sequence
  Description of Artificial Sequence: Synthetic peptide
FTFSRHAMN

SEQ ID NO: 353 - protein, 9 aa, Artificial Sequence
  Description of Artificial Sequence: Synthetic peptide
FVFSSYAMS

SEQ ID NO: 354 - protein, 9 aa, Artificial Sequence
  Description of Artificial Sequence: Synthetic peptide
FTLSSYVMS

SEQ ID NO: 355 - protein, 9 aa, Artificial Sequence
  Description of Artificial Sequence: Synthetic peptide
FTFSTYAMS

SEQ ID NO: 356 - protein, 9 aa, Artificial Sequence
  Description of Artificial Sequence: Synthetic peptide
FTYSNYAMT

SEQ ID NO: 357 - protein, 9 aa, Artificial Sequence
  Description of Artificial Sequence: Synthetic peptide
FTFSNYPMN

SEQ ID NO: 358 - protein, 13 aa, Artificial Sequence
  Description of Artificial Sequence: Synthetic peptide
SIISGSGGATYYA

SEQ ID NO: 359 - protein, 13 aa, Artificial Sequence
  Description of Artificial Sequence: Synthetic peptide
SAITASGDITYYA

SEQ ID NO: 360 - protein, 13 aa, Artificial Sequence
  Description of Artificial Sequence: Synthetic peptide
SAISGSGDITYYA

SEQ ID NO: 361 - protein, 13 aa, Artificial Sequence
  Description of Artificial Sequence: Synthetic peptide
SGISGSGDETYYA

SEQ ID NO: 362 - protein, 13 aa, Artificial Sequence
  Description of Artificial Sequence: Synthetic peptide
SAISGSGDITYYA

SEQ ID NO: 363 - protein, 13 aa, Artificial Sequence
  Description of Artificial Sequence: Synthetic peptide
STISGSGGNTFYA

SEQ ID NO: 364 - protein, 13 aa, Artificial Sequence
  Description of Artificial Sequence: Synthetic peptide
SAITGSGDITYYA

SEQ ID NO: 365 - protein, 13 aa, Artificial Sequence
  Description of Artificial Sequence: Synthetic peptide
STISGSGGITFYA

SEQ ID NO: 366 - protein, 13 aa, Artificial Sequence
  Description of Artificial Sequence: Synthetic peptide
SAISGSGDNTYYA

SEQ ID NO: 367 - protein, 13 aa, Artificial Sequence
  Description of Artificial Sequence: Synthetic peptide
SAITGTGDITYYA

SEQ ID NO: 368 - protein, 13 aa, Artificial Sequence
  Description of Artificial Sequence: Synthetic peptide
SAITGSGDITYYA

SEQ ID NO: 369 - protein, 13 aa, Artificial Sequence
  Description of Artificial Sequence: Synthetic peptide
SAISGSGDITYYA

SEQ ID NO: 370 - protein, 13 aa, Artificial Sequence
  Description of Artificial Sequence: Synthetic peptide
SAISGSGDITYYA

SEQ ID NO: 371 - protein, 13 aa, Artificial Sequence
  Description of Artificial Sequence: Synthetic peptide
STISGSGSTTYYA

SEQ ID NO: 372 - protein, 13 aa, Artificial Sequence
  Description of Artificial Sequence: Synthetic peptide
SVISGSGGSTYYA

SEQ ID NO: 373 - protein, 13 aa, Artificial Sequence
  Description of Artificial Sequence: Synthetic peptide
SAISGSAGSTYYA

SEQ ID NO: 374 - protein, 13 aa, Artificial Sequence
  Description of Artificial Sequence: Synthetic peptide
SAISGSAGSTYYA

SEQ ID NO: 375 - protein, 13 aa, Artificial Sequence
  Description of Artificial Sequence: Synthetic peptide
SVISGSGGSTYYA

SEQ ID NO: 376 - protein, 13 aa, Artificial Sequence
  Description of Artificial Sequence: Synthetic peptide
SVISGSGGSTYYA

SEQ ID NO: 377 - protein, 13 aa, Artificial Sequence
  Description of Artificial Sequence: Synthetic peptide
STISGSGSTTYYA

SEQ ID NO: 378 - protein, 13 aa, Artificial Sequence
  Description of Artificial Sequence: Synthetic peptide
SGISGSGDETYYA

SEQ ID NO: 379 - protein, 13 aa, Artificial Sequence
  Description of Artificial Sequence: Synthetic peptide
SGITGSGDETYYA

SEQ ID NO: 380 - protein, 13 aa, Artificial Sequence
  Description of Artificial Sequence: Synthetic peptide
SAISGSGGSSYYA

SEQ ID NO: 381 - protein, 13 aa, Artificial Sequence
  Description of Artificial Sequence: Synthetic peptide
SGISGGGASTYYA

SEQ ID NO: 382 - protein, 13 aa, Artificial Sequence
  Description of Artificial Sequence: Synthetic peptide
SSIGGSGSTTYYA

SEQ ID NO: 383 - protein, 13 aa, Artificial Sequence
  Description of Artificial Sequence: Synthetic peptide
SAISGSSGSTYYA

SEQ ID NO: 384 - protein, 13 aa, Artificial Sequence
  Description of Artificial Sequence: Synthetic peptide
STISGSGGNTFYA

SEQ ID NO: 385 - protein, 21 aa, Artificial Sequence
  Description of Artificial Sequence: Synthetic peptide
CAKGGYCSSDTCWWEYWLDPW

SEQ ID NO: 386 - protein, 17 aa, Artificial Sequence
  Description of Artificial Sequence: Synthetic peptide
CARQSDGLPSPWHFDLG

SEQ ID NO: 387 - protein, 17 aa, Artificial Sequence
  Description of Artificial Sequence: Synthetic peptide
CAREADGLHSPWHFDLW

SEQ ID NO: 388 - protein, 24 aa, Artificial Sequence
  Description of Artificial Sequence: Synthetic peptide
CARDLPASYYDSSGYYWHNGMDVW

SEQ ID NO: 389 - protein, 17 aa, Artificial Sequence
  Description of Artificial Sequence: Synthetic peptide
CAREADGLHSPWHFDLW

SEQ ID NO: 390 - protein, 12 aa, Artificial Sequence
  Description of Artificial Sequence: Synthetic peptide
CVRHDEYSFDYW

SEQ ID NO: 391 - protein, 17 aa, Artificial Sequence
  Description of Artificial Sequence: Synthetic peptide
CAREADGLHSPWHFDLW

SEQ ID NO: 392 - protein, 12 aa, Artificial Sequence
  Description of Artificial Sequence: Synthetic peptide
CVRHDEYSFDYW

SEQ ID NO: 393 - protein, 12 aa, Artificial Sequence
  Description of Artificial Sequence: Synthetic peptide
CVRHDEYSFDYW

SEQ ID NO: 394 - protein, 12 aa, Artificial Sequence
  Description of Artificial Sequence: Synthetic peptide
CAREADGLHSPW

SEQ ID NO: 395 - protein, 12 aa, Artificial Sequence
  Description of Artificial Sequence: Synthetic peptide
CVRHDEYSFDYW

SEQ ID NO: 396 - protein, 17 aa, Artificial Sequence
  Description of Artificial Sequence: Synthetic peptide
CAREADGLHSPWHFDLW

SEQ ID NO: 397 - protein, 17 aa, Artificial Sequence
  Description of Artificial Sequence: Synthetic peptide
CAREADGLHSPWHFDLW

SEQ ID NO: 398 - protein, 11 aa, Artificial Sequence
  Description of Artificial Sequence: Synthetic peptide
CARLIDAFDIW

SEQ ID NO: 399 - protein, 16 aa, Artificial Sequence
  Description of Artificial Sequence: Synthetic peptide
CAREGYRDYLWYFDLW

SEQ ID NO: 400 - protein, 18 aa, Artificial Sequence
  Description of Artificial Sequence: Synthetic peptide
CARVRQGLRRTWYYFDYW

SEQ ID NO: 401 - protein, 18 aa, Artificial Sequence
  Description of Artificial Sequence: Synthetic peptide
CARDTNDFWSGYSIFDPW

SEQ ID NO: 402 - protein, 16 aa, Artificial Sequence
  Description of Artificial Sequence: Synthetic peptide
CAREGYRDYLWYFDLW

SEQ ID NO: 403 - protein, 14 aa, Artificial Sequence
  Description of Artificial Sequence: Synthetic peptide
CAKGPLVGWYFDLW

SEQ ID NO: 404 - protein, 11 aa, Artificial Sequence
  Description of Artificial Sequence: Synthetic peptide
CARLIDAFDIW

SEQ ID NO: 405 - protein, 17 aa, Artificial Sequence
  Description of Artificial Sequence: Synthetic peptide
CTTGDDFWSGGNWFDPW

SEQ ID NO: 406 - protein, 24 aa, Artificial Sequence
  Description of Artificial Sequence: Synthetic peptide
CARDLPASYYDSSGYYWHNGMDVW

SEQ ID NO: 407 - protein, 15 aa, Artificial Sequence
  Description of Artificial Sequence: Synthetic peptide
CARVGGGYWYGIDVW

SEQ ID NO: 408 - protein, 17 aa, Artificial Sequence
  Description of Artificial Sequence: Synthetic peptide
CARGYSRNWYPSWFDPW

SEQ ID NO: 409 - protein, 10 aa, Artificial Sequence
  Description of Artificial Sequence: Synthetic peptide
CAGGWYLDYW

SEQ ID NO: 410 - protein, 13 aa, Artificial Sequence
  Description of Artificial Sequence: Synthetic peptide
CASLCIVDPFDIW

SEQ ID NO: 411 - protein, 12 aa, Artificial Sequence
  Description of Artificial Sequence: Synthetic peptide
CVRHDEYSFDYW

SEQ ID NO: 412 - protein, 11 aa, Artificial Sequence
  Description of Artificial Sequence: Synthetic peptide
RASQSIHRFLN

SEQ ID NO: 413 - protein, 11 aa, Artificial Sequence
  Description of Artificial Sequence: Synthetic peptide
RASQSIHISLN

SEQ ID NO: 414 - protein, 11 aa, Artificial Sequence
  Description of Artificial Sequence: Synthetic peptide
RASQSIHTYLN

SEQ ID NO: 415 - protein, 11 aa, Artificial Sequence
  Description of Artificial Sequence: Synthetic peptide
RASQTINTYLN

SEQ ID NO: 416 - protein, 11 aa, Artificial Sequence
  Description of Artificial Sequence: Synthetic peptide
RASQSIDTYLN

SEQ ID NO: 417 - protein, 11 aa, Artificial Sequence
  Description of Artificial Sequence: Synthetic peptide
RASQSIGNYLN

SEQ ID NO: 418 - protein, 11 aa, Artificial Sequence
  Description of Artificial Sequence: Synthetic peptide
RASQSIDTYLN

SEQ ID NO: 419 - protein, 11 aa, Artificial Sequence
  Description of Artificial Sequence: Synthetic peptide
RASQSIDNYLN

SEQ ID NO: 420 - protein, 11 aa, Artificial Sequence
  Description of Artificial Sequence: Synthetic peptide
RASQSIDTYLN

SEQ ID NO: 421 - protein, 11 aa, Artificial Sequence
  Description of Artificial Sequence: Synthetic peptide
RASQSIDTYLN

SEQ ID NO: 422 - protein, 11 aa, Artificial Sequence
  Description of Artificial Sequence: Synthetic peptide
RASQSIDTYLN

SEQ ID NO: 423 - protein, 11 aa, Artificial Sequence
  Description of Artificial Sequence: Synthetic peptide
RASQSIDTYLN

SEQ ID NO: 424 - protein, 11 aa, Artificial Sequence
  Description of Artificial Sequence: Synthetic peptide
RASQSIDNYLN

SEQ ID NO: 425 - protein, 11 aa, Artificial Sequence
  Description of Artificial Sequence: Synthetic peptide
RASQRIGTYLN

SEQ ID NO: 426 - protein, 14 aa, Artificial Sequence
  Description of Artificial Sequence: Synthetic peptide
TGTSSDVGSYDLVS

SEQ ID NO: 427 - protein, 14 aa, Artificial Sequence
  Description of Artificial Sequence: Synthetic peptide
TGTSSDVGSSNLVS

SEQ ID NO: 428 - protein, 14 aa, Artificial Sequence
  Description of Artificial Sequence: Synthetic peptide
TGTSSDIGSYNLVS

SEQ ID NO: 429 - protein, 14 aa, Artificial Sequence
  Description of Artificial Sequence: Synthetic peptide
TGTSTDVGSYNLVS

SEQ ID NO: 430 - protein, 14 aa, Artificial Sequence
  Description of Artificial Sequence: Synthetic peptide
TGTSSNVGSYNLVS

SEQ ID NO: 431 - protein, 11 aa, Artificial Sequence
  Description of Artificial Sequence: Synthetic peptide
RASQSIHTYLN

SEQ ID NO: 432 - protein, 11 aa, Artificial Sequence
  Description of Artificial Sequence: Synthetic peptide
RASQSIHTYLN

SEQ ID NO: 433 - protein, 11 aa, Artificial Sequence
  Description of Artificial Sequence: Synthetic peptide
RASQTINTFLN

SEQ ID NO: 434 - protein, 11 aa, Artificial Sequence
  Description of Artificial Sequence: Synthetic peptide
RASQTIRTYLN

SEQ ID NO: 435 - protein, 11 aa, Artificial Sequence
  Description of Artificial Sequence: Synthetic peptide
RSSQSISSYLN

SEQ ID NO: 436 - protein, 11 aa, Artificial Sequence
  Description of Artificial Sequence: Synthetic peptide
RASQSISGSLN

SEQ ID NO: 437 - protein, 11 aa, Artificial Sequence
  Description of Artificial Sequence: Synthetic peptide
RASRSISTYLN

SEQ ID NO: 438 - protein, 11 aa, Artificial Sequence
  Description of Artificial Sequence: Synthetic peptide
RASQSIHTYLN

SEQ ID NO: 439 - protein, 7 aa, Artificial Sequence
  Description of Artificial Sequence: Synthetic peptide
AASNLHS

SEQ ID NO: 440 - protein, 7 aa, Artificial Sequence
  Description of Artificial Sequence: Synthetic peptide
LASPLAS

SEQ ID NO: 441 - protein, 7 aa, Artificial Sequence
  Description of Artificial Sequence: Synthetic peptide
AASALAS

SEQ ID NO: 442 - protein, 7 aa, Artificial Sequence
  Description of Artificial Sequence: Synthetic peptide
SASTLQS

SEQ ID NO: 443 - protein, 7 aa, Artificial Sequence
  Description of Artificial Sequence: Synthetic peptide
AASALAS

SEQ ID NO: 444 - protein, 7 aa, Artificial Sequence
  Description of Artificial Sequence: Synthetic peptide
GVSSLQS

SEQ ID NO: 445 - protein, 7 aa, Artificial Sequence
  Description of Artificial Sequence: Synthetic peptide
AASALAS

SEQ ID NO: 446 - protein, 7 aa, Artificial Sequence
  Description of Artificial Sequence: Synthetic peptide
GVSALQS

SEQ ID NO: 447 - protein, 7 aa, Artificial Sequence
  Description of Artificial Sequence: Synthetic peptide
GASALES

SEQ ID NO: 448 - protein, 7 aa, Artificial Sequence
  Description of Artificial Sequence: Synthetic peptide
AASALAS

SEQ ID NO: 449 - protein, 7 aa, Artificial Sequence
  Description of Artificial Sequence: Synthetic peptide
GVSALQS

SEQ ID NO: 450 - protein, 7 aa, Artificial Sequence
  Description of Artificial Sequence: Synthetic peptide
AASALAS

SEQ ID NO: 451 - protein, 7 aa, Artificial Sequence
  Description of Artificial Sequence: Synthetic peptide
GVSALQS

SEQ ID NO: 452 - protein, 7 aa, Artificial Sequence
  Description of Artificial Sequence: Synthetic peptide
AASNLEG

SEQ ID NO: 453 - protein, 7 aa, Artificial Sequence
  Description of Artificial Sequence: Synthetic peptide
EGNKRPS

SEQ ID NO: 454 - protein, 7 aa, Artificial Sequence
  Description of Artificial Sequence: Synthetic peptide
EGSKRPS

SEQ ID NO: 455 - protein, 7 aa, Artificial Sequence
  Description of Artificial Sequence: Synthetic peptide
EGTKRPS

SEQ ID NO: 456 - protein, 7 aa, Artificial Sequence
  Description of Artificial Sequence: Synthetic peptide
EGTKRPS

SEQ ID NO: 457 - protein, 7 aa, Artificial Sequence
  Description of Artificial Sequence: Synthetic peptide
EGTKRPS

SEQ ID NO: 458 - protein, 7 aa, Artificial Sequence
  Description of Artificial Sequence: Synthetic peptide
AASALAS

SEQ ID NO: 459 - protein, 7 aa, Artificial Sequence
  Description of Artificial Sequence: Synthetic peptide
AASALAS

SEQ ID NO: 460 - protein, 7 aa, Artificial Sequence
  Description of Artificial Sequence: Synthetic peptide
SASTLQS

SEQ ID NO: 461 - protein, 7 aa, Artificial Sequence
  Description of Artificial Sequence: Synthetic peptide
DASTLQR

SEQ ID NO: 462 - protein, 7 aa, Artificial Sequence
  Description of Artificial Sequence: Synthetic peptide
GASRLRS

SEQ ID NO: 463 - protein, 7 aa, Artificial Sequence
  Description of Artificial Sequence: Synthetic peptide
AESRLHS

SEQ ID NO: 464 - protein, 7 aa, Artificial Sequence
  Description of Artificial Sequence: Synthetic peptide
AASNLQG

SEQ ID NO: 465 - protein, 7 aa, Artificial Sequence
  Description of Artificial Sequence: Synthetic peptide
AASALAS

SEQ ID NO: 466 - protein, 11 aa, Artificial Sequence
  Description of Artificial Sequence: Synthetic peptide
CQQSYGLPPTF

SEQ ID NO: 467 - protein, 12 aa, Artificial Sequence [sequence omitted]

SEQ ID NO: 468 - protein, 12 aa, Artificial Sequence [sequence omitted]

SEQ ID NO: 469 - protein, 10 aa, Artificial Sequence [sequence omitted]

SEQ ID NO: 470 - protein, 12 aa, Artificial Sequence [sequence omitted]

SEQ ID NO: 471 - protein, 11 aa, Artificial Sequence [sequence omitted]

SEQ ID NO: 472 - protein, 12 aa, Artificial Sequence [sequence omitted]

SEQ ID NO: 473 - protein, 12 aa, Artificial Sequence
  Description of Artificial Sequence: Synthetic peptide
CQQSHSAPPYFF

SEQ ID NO: 474 - protein, 12 aa, Artificial Sequence
  Description of Artificial Sequence: Synthetic peptide
CQQSHSAPPYFF

SEQ ID NO: 475 - protein, 12 aa, Artificial Sequence [sequence omitted]

SEQ ID NO: 476 - protein, 12 aa, Artificial Sequence
  Description of Artificial Sequence: Synthetic peptide
CQQSYSAPPYFF

SEQ ID NO: 477 - protein, 12 aa, Artificial Sequence [sequence omitted]

SEQ ID NO: 478 - protein, 11 aa, Artificial Sequence [sequence omitted]

SEQ ID NO: 479 - protein, 11 aa, Artificial Sequence
  Description of Artificial Sequence: Synthetic peptide
CQQNYSTTWTF

SEQ ID NO: 480 - protein, 11 aa, Artificial Sequence [sequence omitted]

SEQ ID NO: 481 - protein, 11 aa, Artificial Sequence [sequence omitted]

SEQ ID NO: 482 - protein, 12 aa, Artificial Sequence [sequence omitted]

SEQ ID NO: 483 - protein, 13 aa, Artificial Sequence [sequence omitted]

SEQ ID NO: 484 - protein, 13 aa, Artificial Sequence [sequence omitted]

SEQ ID NO: 485 - protein, 12 aa, Artificial Sequence [sequence omitted]

SEQ ID NO: 486 - protein, 12 aa, Artificial Sequence [sequence omitted]

SEQ ID NO: 487 - protein, 10 aa, Artificial Sequence [sequence omitted]

SEQ ID NO: 488 - protein, 12 aa, Artificial Sequence [sequence omitted]

SEQ ID NO: 489 - protein, 11 aa, Artificial Sequence
  Description of Artificial Sequence: Synthetic peptide
CQQGYSAPWTF

SEQ ID NO: 490 - protein, 11 aa, Artificial Sequence [sequence omitted]

SEQ ID NO: 491 - protein, 11 aa, Artificial Sequence [sequence omitted]

SEQ ID NO: 492 - protein, 12 aa, Artificial Sequence [sequence omitted]

SEQ ID NO: 493 - protein, 126 aa, Artificial Sequence
  Description of Artificial Sequence: Synthetic polypeptide
EVQLLESGGGLVQPGGSLRLSCAASGFTFSNYATDWVRQAPGKGLEWVSIISGSGGATYYADSVKGRFTISRDNSKNTLYLQMNSLRAEDTAVYYCAKGGYCSSDTCWWEYWLDPWGQGTLVTVSS

SEQ ID NO: 494 - protein, 122 aa, Artificial Sequence
  Description of Artificial Sequence: Synthetic polypeptide
EVQLLESGGGLVQPGGSLRLSCAASGFTFSAFAMGWVRQAPGKGLEWVSAITASGDITYYADSVKGRFTISRDNSKNTLYLQMNSLRAEDTAVYYCARQSDGLPSPWHFDLGGQGTLVTVSS

SEQ ID NO: 495 - protein, 122 aa, Artificial Sequence
  Description of Artificial Sequence: Synthetic polypeptide
EVQLLESGGGLVQPGGSLRLSCAASGFTFSDFAMAWVRQAPGKGLEWVSAISGSGDITYYADSVKGRFTISRDNSKNTLYLQMNSLRAEDTAVYYCAREADGLHSPWHFDLWGQGTLVTVSS

SEQ ID NO: 496 - protein, 129 aa, Artificial Sequence
  Description of Artificial Sequence: Synthetic polypeptide
EVQLLESGGGLVQPGGSLRLSCAASGFTFSRHAMNWVRQAPGKGLEWVSGISGSGDETYYADSVKGRFTISRDNSKNTLYLQMNSLRAEDTAVYYCARDLPASYYDSSGYYWHNGMDVWGQGTLVTVSS

SEQ ID NO: 497 - protein, 122 aa, Artificial Sequence; identical to SEQ ID NO: 495
  Description of Artificial Sequence: Synthetic polypeptide

SEQ ID NO: 498 - protein, 117 aa, Artificial Sequence
  Description of Artificial Sequence: Synthetic polypeptide
EVQLLESGGGLVQPGGSLRLSCAASGFTFSNYPMNWVRQAPGKGLEWVSTISGSGGNTFYADSVKGRFTISRDNSKNTLYLQMNSLRAEDTAVYYCVRHDEYSFDYWGQGTLVTVSS

SEQ ID NO: 499 - protein, 122 aa, Artificial Sequence
  Description of Artificial Sequence: Synthetic polypeptide
EVQLLESGGGLVQPGGSLRLSCAASGFTFSDFAMAWVRQAPGKGLEWVSAITGSGDITYYADSVKGRFTISRDNSKNTLYLQMNSLRAEDTAVYYCAREADGLHSPWHFDLWGQGTLVTVSS

SEQ ID NO: 500 - protein, 117 aa, Artificial Sequence
  Description of Artificial Sequence: Synthetic polypeptide
EVQLLESGGGLVQPGGSLRLSCAASGFTFSDYPMNWVRQAPGKGLEWVSTISGSGGITFYADSVKGRFTISRDNSKNTLYLQMNSLRAEDTAVYYCVRHDEYSFDYWGQGTLVTVSS

SEQ ID NO: 501 - protein, 117 aa, Artificial Sequence
  Description of Artificial Sequence: Synthetic polypeptide
EVQLLESGGGLVQPGGSLRLSCAASGFTFSDYPMNWVRQAPGKGLEWVSAISGSGDNTYYADSVKGRFTISRDNSKNTLYLQMNSLRAEDTAVYYCVRHDEYSFDYWGQGTLVTVSS

SEQ ID NO: 502 - protein, 117 aa, Artificial Sequence
  Description of Artificial Sequence: Synthetic polypeptide
EVQLLESGGGLVQPGGSLRLSCAASGFTFSDFAMAWVRQAPGKGLEWVSAITGTGDITYYADSVKGRFTISRDNSKNTLYLQMNSLRAEDTAVYYCAREADGLHSPWGQGTLVTVSS

SEQ ID NO: 503 - protein, 117 aa, Artificial Sequence
  Description of Artificial Sequence: Synthetic polypeptide
EVQLLESGGGLVQPGGSLRLSCAASGFTFSDYPMNWVRQAPGKGLEWVSAITGSGDITYYADSVKGRFTISRDNSKNTLYLQMNSLRAEDTAVYYCVRHDEYSFDYWGQGTLVTVSS

SEQ ID NO: 504 - protein, 122 aa, Artificial Sequence; identical to SEQ ID NO: 495
  Description of Artificial Sequence: Synthetic polypeptide

SEQ ID NO: 505 - protein, 122 aa, Artificial Sequence; identical to SEQ ID NO: 495
  Description of Artificial Sequence: Synthetic polypeptide

SEQ ID NO: 506 - protein, 116 aa, Artificial Sequence
  Description of Artificial Sequence: Synthetic polypeptide
EVQLLESGGGLVQPGGSLRLSCAASGFTFPRYAMSWVRQAPGKGLEWVSTISGSGSTTYYADSVKGRFTISRDNSKNTLYLQMNSLRAEDTAVYYCARLIDAFDIWGQGTLVTVSS

SEQ ID NO: 507 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCAREGYRDYLWYFDLWGQGTLVTVSS

SEQ ID NO: 508 - protein, 123 aa, Artificial Sequence
  Description of Artificial Sequence: Synthetic polypeptide
EVQLLESGGGLVQPGGSLRLSCAASGFTFSNYAMSWVRQAPGKGLEWVSAISGSAGSTYYADSVKGRFTISRDNSKNTLYLQMNSLRAEDTAVYYCARVRQGLRRTWYYFDYWGQGTLVTVSS

SEQ ID NO: 509 - protein, 123 aa, Artificial Sequence
  Description of Artificial Sequence: Synthetic polypeptide
EVQLLESGGGLVQPGGSLRLSCAASGFTFSSYAMYWVRQAPGKGLEWVSAISGSAGSTYYADSVKGRFTISRDNSKNTLYLQMNSLRAEDTAVYYCARDTNDFWSGYSIFDPWGQGTLVTVSS

SEQ ID NO: 510 - protein, 121 aa, Artificial Sequence
  Description of Artificial Sequence: Synthetic polypeptide
EVQLLESGGGLVQPGGSLRLSCAASGFTFSSYTMSWVRQAPGKGLEWVSVISGSGGSTYYADSVKGRFTISRDNSKNTLYLQMNSLRAEDTAVYYCAREGYRDYLWYFDLWGQGTLVTVSS

SEQ ID NO: 511 - protein, 119 aa, Artificial Sequence
  Description of Artificial Sequence: Synthetic polypeptide
EVQLLESGGGLVQPGGSLRLSCAASGFTFSSYDMSWVRQAPGKGLEWVSVISGSGGSTYYADSVKGRFTISRDNSKNTLYLQMNSLRAEDTAVYYCAKGPLVGWYFDLWGQGTLVTVSS

SEQ ID NO: 512 - protein, 116 aa, Artificial Sequence; identical to SEQ ID NO: 506
  Description of Artificial Sequence: Synthetic polypeptide

SEQ ID NO: 513 - protein, 122 aa, Artificial Sequence
  Description of Artificial Sequence: Synthetic polypeptide
EVQLLESGGGLVQPGGSLRLSCAASGFTFTTYALSWVRQAPGKGLEWVSGISGSGDETYYADSVKGRFTISRDNSKNTLYLQMNSLRAEDTAVYYCTTGDDFWSGGNWFDPWGQGTLVTVSS

SEQ ID NO: 514 - protein, 129 aa, Artificial Sequence
  Description of Artificial Sequence: Synthetic polypeptide
EVQLLESGGGLVQPGGSLRLSCAASGFTFSRHAMNWVRQAPGKGLEWVSGITGSGDETYYADSVKGRFTISRDNSKNTLYLQMNSLKAEDTAVYYCARDLPASYYDSSGYYWHNGMDVWGQGTLVTVSS

SEQ ID NO: 515 - protein, 120 aa, Artificial Sequence
  Description of Artificial Sequence: Synthetic polypeptide
EVQLLESGGGLVQPGGSLRLSCAASGFVFSSYAMSWVRQAPGKGLEWVSAISGSGGSSYYADSVKGRFTISRDNSKNTLYLQMNSLRAEDTAVYYCARVGGGYWYGIDVWGQGTLVTVSS

SEQ ID NO: 516 - protein, 122 aa, Artificial Sequence
  Description of Artificial Sequence: Synthetic polypeptide
EVQLLESGGGLVQPGGSLRLSCAASGFTLSSYVMSWVRQAPGKGLEWVSGISGGGASTYYADSVKGRFTISRDNSKNTLYLQMNSLRAEDTAVYYCARGYSRNWYPSWFDPWGQGTLVTVSS

SEQ ID NO: 517 - protein, 115 aa, Artificial Sequence
  Description of Artificial Sequence: Synthetic polypeptide
EVQLLESGGGLVQPGGSLRLSCAASGFTFSTYAMSWVRQAPGKGLEWVSSIGGSGSTTYYADSVKGRFTISRDNSKNTLYLQMNSLRAEDTAVYYCAGGWYLDYWGQGTLVTVSS

SEQ ID NO: 518 - protein, 118 aa, Artificial Sequence
  Description of Artificial Sequence: Synthetic polypeptide
EVQLLGSGGGLVQPGGSLRLSCAASGFTYSNYAMTWVRQAPGKGLEWVSAISGSSGSTYYADSVKGRFTISRDNSKNTLYLQMNSLRAEDTAVYYCASLCIVDPFDIWGQGTLVTVSS

SEQ ID NO: 519 - protein, 117 aa, Artificial Sequence; identical to SEQ ID NO: 498
  Description of Artificial Sequence: Synthetic polypeptide

SEQ ID NO: 520 - protein, 107 aa, Artificial Sequence
  Description of Artificial Sequence: Synthetic polypeptide
DIQMTQSPSSLSASVGDRVTITCRASQSIHRFLNWYQQKPGKAPKLLIYAASNLHSGVPSRFSGSGSGTDFTLTISSLQPEDFATYYCQQSYGLPPTFGQGTKVEIK

SEQ ID NO: 521 - protein, 108 aa, Artificial Sequence
  Description of Artificial Sequence: Synthetic polypeptide
DIQMTQSPSSLSASVGDRVTITCRASQSIHISLNWYQQKPGKAPKLLIYLASPLASGVPSRFSGSGSGTDFTLTISSLQPEDFATYYCQQSYSAPPYTFGQGTKVEIK

SEQ ID NO: 522 - protein, 108 aa, Artificial Sequence
  Description of Artificial Sequence: Synthetic polypeptide
DIQMTQSPSSLSASVGDRVTITCRASQSIHTYLNWYQQKPGKAPKLLIYAASALASGVPSRFSGSGSGTDFTLTISSLQPEDFATYYCQQSYSAPPYTFGQGTKVEIK

SEQ ID NO: 523 - protein, 106 aa, Artificial Sequence
  Description of Artificial Sequence: Synthetic polypeptide
DIQMTQSPSSLSASVGDRVTITCRASQTINTYLNWYQQKPGKAPKLLIYSASTLQSGVPSRFSGSGSGTDFTLTISSLQPEDFATYYCQQSYSTFTFGQGTKVEIK

SEQ ID NO: 524 - protein, 108 aa, Artificial Sequence
  Description of Artificial Sequence: Synthetic polypeptide
DIQMTQSPSSLSASVGDRVTITCRASQSIDTYLNWYQQKPGKAPKLLIYAASALASGVPSRFSGSGSGTDFTLTISSLQPEDFATYYCQQSYSAPPYTFGQGTKVEIK

SEQ ID NO: 525 - protein, 108 aa, Artificial Sequence; identical to SEQ ID NO: 524
  Description of Artificial Sequence: Synthetic polypeptide

SEQ ID NO: 526 - protein, 107 aa, Artificial Sequence
  Description of Artificial Sequence: Synthetic polypeptide
DIQMTQSPSSLSASVGDRVTITCRASQSIGNYLNWYQQKPGKAPKLLIYGVSSLQSGVPSRFSGSGSGTDFTLTISSLQPEDFATYYCQQSHSAPLTFGQGTKVEIK

SEQ ID NO: 527 - protein, 108 aa, Artificial Sequence
  Description of Artificial Sequence: Synthetic polypeptide
DIQMTQSPSSLSASVGDRVTITCRASQSIDNYLNWYQQKPGKAPKLLIYGVSALQSGVPSRFSGSGSGTDFTLTISSLQPEDFATYYCQQSHSAPPYFFGQGTKVEIK

SEQ ID NO: 528 - protein, 108 aa, Artificial Sequence
  Description of Artificial Sequence: Synthetic polypeptide
DIQMTQSPSSLSASVGDRVTITCRASQSIDTYLNWYQQKPGKAPKLLIYGASALESGVPSRFSGSGSGTDFTLTISSLQPEDFATYYCQQSHSAPPYFFGQGTKVEIK

SEQ ID NO: 529 - protein, 108 aa, Artificial Sequence
  Description of Artificial Sequence: Synthetic polypeptide
DIQMTQSPSSLSASVGDRVTITCRASQSIDTYLNWYQQKPGKAPKLLIYGVSALQSGVPSRFSGSGSGTDFTLTISSLQPEDFATYYCQQSYSAPPYFFGQGTKVEIK

SEQ ID NO: 530 - protein, 108 aa, Artificial Sequence; identical to SEQ ID NO: 524
  Description of Artificial Sequence: Synthetic polypeptide

SEQ ID NO: 531 - protein, 108 aa, Artificial Sequence; identical to SEQ ID NO: 524
  Description of Artificial Sequence: Synthetic polypeptide

SEQ ID NO: 532 - protein, 107 aa, Artificial Sequence
  Description of Artificial Sequence: Synthetic polypeptide
DIQMTQSPSSLSASVGDRVTITCRASQSIDNYLNWYQQKPGKAPKLLIYGVSALQSGVPSRFSGSGSGTDFTLTISSLQPEDFATYYCQQSHSAPLTFGQGTKVEIK

SEQ ID NO: 533 - protein, 107 aa, Artificial Sequence
  Description of Artificial Sequence: Synthetic polypeptide
DIQMTQSPSSLSASVGDRVTITCRASQRIGTYLNWYQQKPGKAPKLLIYAASNLEGGVPSRFSGSGSGTDFTLTISSLQPEDFATYYCQQNYSTTWTFGQGTKVEIK

SEQ ID NO: 534 - protein, 110 aa, Artificial Sequence
  Description of Artificial Sequence: Synthetic polypeptide
DIQMTQSPSSLSASVGDRVTITCTGTSSDVGSYDLVSWYQQKPGKAPKLLIYEGNKRPSGVPSRFSGSGSGTDFTLTISSLQPEDFATYYCCSYAGSSVVFGQGTKVEIK

SEQ ID NO: 535 - protein, 110 aa, Artificial Sequence
  Description of Artificial Sequence: Synthetic polypeptide
DIQMTQSPSSLSASVGDRVTITCTGTSSDVGSSNLVSWYQQKPGKAPKLLIYEGSKRPSGVPSRFSGSGSGTDFTLTISSLQPEDFATYYCCSYAGSLYVFGQGTKVEIK

SEQ ID NO: 536 - protein, 111 aa, Artificial Sequence
  Description of Artificial Sequence: Synthetic polypeptide
DIQMTQSPSSLSASVGDRVTITCTGTSSDIGSYNLVSWYQQKPGKAPKLLIYEGTKRPSGVPSRFSGSGSGTDFTLTISSLQPEDFATYYCCSYAGSRTYVFGQGTKVEIK

SEQ ID NO: 537 - protein, 112 aa, Artificial Sequence
  Description of Artificial Sequence: Synthetic polypeptide
DIQMTQSPSSLSASVGDRVTITCTGTSTDVGSYNLVSWYQQKPGKAPKLLIYEGTKRPSGVPSRFSGSGSGTDFTLTISSLQPEDFATYYCCSYAGSYTSVVFGQGTKVEIK

SEQ ID NO: 538 - protein, 112 aa, Artificial Sequence
  Description of Artificial Sequence: Synthetic polypeptide
DIQMTQSPSSLSASVGDRVTITCTGTSSNVGSYNLVSWYQQKPGKAPKLLIYEGTKRPSGVPSRFSGSGSGTDFTLTISSLQPEDFATYYCCSYAGSSSFVVFGQGTKVEIK

SEQ ID NO: 539 - protein, 108 aa, Artificial Sequence; identical to SEQ ID NO: 522
  Description of Artificial Sequence: Synthetic polypeptide

SEQ ID NO: 540 - protein, 108 aa, Artificial Sequence; identical to SEQ ID NO: 522
  Description of Artificial Sequence: Synthetic polypeptide

SEQ ID NO: 541 - protein, 106 aa, Artificial Sequence
  Description of Artificial Sequence: Synthetic polypeptide
DIQMTQSPSSLSASVGDRVTITCRASQTINTFLNWYQQKPGKAPKLLIYSASTLQSGVPSRFSGSGSGTDFTLTISSLQPEDFATYYCQQSYSTFTFGGGTKVEIK

SEQ ID NO: 542 - protein, 108 aa, Artificial Sequence
  Description of Artificial Sequence: Synthetic polypeptide
DIQMTQSPSSLSASVGDRVTITCRASQTIRTYLNWYRQKPGKAPKLLIYDASTLQRGVPSRFSGSGSGTDFTLTISSLQPEDFATYYCQQSYRTPPWTFGGGTKVEIK

SEQ ID NO: 543 - protein, 107 aa, Artificial Sequence
  Description of Artificial Sequence: Synthetic polypeptide
DIQMTQSPSSLSASVGDRVTITCRSSQSISSYLNWYQQKPGEAPKLLIYGASRLRSGVPSRFSGSGSGTDFTLTISSLQPEDFATYYCQQGYSAPWTFGGGTKVEIK

SEQ ID NO: 544 - protein, 107 aa, Artificial Sequence
  Description of Artificial Sequence: Synthetic polypeptide
DIQMTQSPSSLSASVGDRVTITCRASQSISGSLNWYQQKPGKAPKLLIYAESRLHSGVPSRFSGSGSGTDFTLTISSLQPEDFATYYCQQSYSPPQTFGGGTKVEIK

SEQ ID NO: 545 - protein, 107 aa, Artificial Sequence
  Description of Artificial Sequence: Synthetic polypeptide
DIQMTQSPSSLSASVGDRVTITCRASRSISTYLNWYQQKPGKAPKLLIYAASNLQGGVPSRLSGSGSGTDFTLTISSLQPEDFATYYCQQSHSIPRTFGGGTKVEIK

SEQ ID NO: 546 - protein, 108 aa, Artificial Sequence; identical to SEQ ID NO: 522
  Description of Artificial Sequence: Synthetic polypeptide

SEQ ID NO: 547 - protein, 9 aa, Artificial Sequence
  Description of Artificial Sequence: Synthetic peptide
FTFRSHAMS

SEQ ID NO: 548 - protein, 9 aa, Artificial Sequence
  Description of Artificial Sequence: Synthetic peptide
FTFSAYSMS

SEQ ID NO: 549 - protein, 9 aa, Artificial Sequence
  Description of Artificial Sequence: Synthetic peptide
FMFGNYAMS

SEQ ID NO: 550 - protein, 9 aa, Artificial Sequence
  Description of Artificial Sequence: Synthetic peptide
FTFRNHAMA

SEQ ID NO: 551 - protein, 9 aa, Artificial Sequence
  Description of Artificial Sequence: Synthetic peptide
FTIPNYAMS

SEQ ID NO: 552 - protein, 9 aa, Artificial Sequence
  Description of Artificial Sequence: Synthetic peptide
FTFRNYAMA

SEQ ID NO: 553 - protein, 9 aa, Artificial Sequence
  Description of Artificial Sequence: Synthetic peptide
FTIRNYAMS

SEQ ID NO: 554 - protein, 9 aa, Artificial Sequence
  Description of Artificial Sequence: Synthetic peptide
FTIPNYAMS

SEQ ID NO: 555 - protein, 9 aa, Artificial Sequence
  Description of Artificial Sequence: Synthetic peptide
FTITNYAMS

SEQ ID NO: 556 - protein, 9 aa, Artificial Sequence
  Description of Artificial Sequence: Synthetic peptide
FTFRSHAMS

SEQ ID NO: 557 - protein, 9 aa, Artificial Sequence
  Description of Artificial Sequence: Synthetic peptide
FTITNYAMS

SEQ ID NO: 558 - protein, 9 aa, Artificial Sequence
  Description of Artificial Sequence: Synthetic peptide
FTFRSHAMN

SEQ ID NO: 559 - protein, 9 aa, Artificial Sequence
  Description of Artificial Sequence: Synthetic peptide
FTFRSHAMS

SEQ ID NO: 560 - protein, 9 aa, Artificial Sequence
  Description of Artificial Sequence: Synthetic peptide
FTFRSYAMS

SEQ ID NO: 561 - protein, 9 aa, Artificial Sequence
  Description of Artificial Sequence: Synthetic peptide
FTITNYAMS

SEQ ID NO: 562 - protein, 9 aa, Artificial Sequence
  Description of Artificial Sequence: Synthetic peptide
FTFTNFAMS

SEQ ID NO: 563 - protein, 9 aa, Artificial Sequence
  Description of Artificial Sequence: Synthetic peptide
FTFRSYPMS

SEQ ID NO: 564 - protein, 9 aa, Artificial Sequence
  Description of Artificial Sequence: Synthetic peptide
FTLTSYAMS

SEQ ID NO: 565 - protein, 9 aa, Artificial Sequence
  Description of Artificial Sequence: Synthetic peptide
FTFINYAMS

SEQ ID NO: 566 - protein, 9 aa, Artificial Sequence
  Description of Artificial Sequence: Synthetic peptide
FPFSTYAMS

SEQ ID NO: 567 - protein, 9 aa, Artificial Sequence
  Description of Artificial Sequence: Synthetic peptide
FTFSTYAMG

SEQ ID NO: 568 - protein, 9 aa, Artificial Sequence
  Description of Artificial Sequence: Synthetic peptide
FIFSDYAMT

SEQ ID NO: 569 - protein, 9 aa, Artificial Sequence
  Description of Artificial Sequence: Synthetic peptide
FTFSDYAMT

SEQ ID NO: 570 - protein, 9 aa, Artificial Sequence
  Description of Artificial Sequence: Synthetic peptide
FTFSIYAMG

SEQ ID NO: 571 - protein, 9 aa, Artificial Sequence
  Description of Artificial Sequence: Synthetic peptide
FTFASYAMT

SEQ ID NO: 572 - protein, 9 aa, Artificial Sequence
  Description of Artificial Sequence: Synthetic peptide
FTFSEYAMS

SEQ ID NO: 573 - protein, 9 aa, Artificial Sequence
  Description of Artificial Sequence: Synthetic peptide
FTFDDYAMS

SEQ ID NO: 574 - protein, 9 aa, Artificial Sequence
  Description of Artificial Sequence: Synthetic peptide
FTFNNYAMN

SEQ ID NO: 575 - protein, 9 aa, Artificial Sequence
  Description of Artificial Sequence: Synthetic peptide
FTFTNHAMS

SEQ ID NO: 576 - protein, 13 aa, Artificial Sequence
  Description of Artificial Sequence: Synthetic peptide
SSISGGGASTYYA

SEQ ID NO: 577 - protein, 13 aa, Artificial Sequence
  Description of Artificial Sequence: Synthetic peptide
SAISGSGGSRYYA

SEQ ID NO: 578 - protein, 13 aa, Artificial Sequence
  Description of Artificial Sequence: Synthetic peptide
AAISGSGGSTYYA

SEQ ID NO: 579 - protein, 13 aa, Artificial Sequence
  Description of Artificial Sequence: Synthetic peptide
SGISGSGGTTYYG

SEQ ID NO: 580 - protein, 13 aa, Artificial Sequence
  Description of Artificial Sequence: Synthetic peptide
SGISGAGASTYYA

SEQ ID NO: 581 - protein, 13 aa, Artificial Sequence
  Description of Artificial Sequence: Synthetic peptide
SGISGSGGTTYYG

SEQ ID NO: 582 - protein, 13 aa, Artificial Sequence
  Description of Artificial Sequence: Synthetic peptide
SSISGGGASTYYA

SEQ ID NO: 583 - protein, 13 aa, Artificial Sequence
  Description of Artificial Sequence: Synthetic peptide
SGISGSGASTYYA

SEQ ID NO: 584 - protein, 13 aa, Artificial Sequence
  Description of Artificial Sequence: Synthetic peptide
SGISGSGAGTYYA

SEQ ID NO: 585 - protein, 13 aa, Artificial Sequence
  Description of Artificial Sequence: Synthetic peptide
SSISGGGASTYYA

SEQ ID NO: 586 - protein, 13 aa, Artificial Sequence
  Description of Artificial Sequence: Synthetic peptide
SGISGSGASTYYA

SEQ ID NO: 587 - protein, 13 aa, Artificial Sequence
  Description of Artificial Sequence: Synthetic peptide
SAISGSGGSTNYA

SEQ ID NO: 588 - protein, 13 aa, Artificial Sequence
  Description of Artificial Sequence: Synthetic peptide
SSISGGGASTYYA

SEQ ID NO: 589 - protein, 13 aa, Artificial Sequence
  Description of Artificial Sequence: Synthetic peptide
SSISGGGASTYYA

SEQ ID NO: 590 - protein, 13 aa, Artificial Sequence
  Description of Artificial Sequence: Synthetic peptide
SGISGSGAGTYYA

SEQ ID NO: 591 - protein, 13 aa, Artificial Sequence
  Description of Artificial Sequence: Synthetic peptide
SAISGRGGGTYYA

SEQ ID NO: 592 - protein, 13 aa, Artificial Sequence
  Description of Artificial Sequence: Synthetic peptide
STISGSGGITYYA

SEQ ID NO: 593 - protein, 13 aa, Artificial Sequence
  Description of Artificial Sequence: Synthetic peptide
SAISGSGVDTYYA

SEQ ID NO: 594 - protein, 13 aa, Artificial Sequence
  Description of Artificial Sequence: Synthetic peptide
STISTSGGNTYYA

SEQ ID NO: 595 - protein, 13 aa, Artificial Sequence
  Description of Artificial Sequence: Synthetic peptide
SGISVSGGFTYYA

SEQ ID NO: 596 - protein, 13 aa, Artificial Sequence
  Description of Artificial Sequence: Synthetic peptide
SGISGGGVSTYYA

SEQ ID NO: 597 - protein, 10 aa, Artificial Sequence
  Description of Artificial Sequence: Synthetic peptide
SAISGSAFYA

SEQ ID NO: 598 - protein, 13 aa, Artificial Sequence
  Description of Artificial Sequence: Synthetic peptide
SDISGSGGSTYYA

SEQ ID NO: 599 - protein, 13 aa, Artificial Sequence
  Description of Artificial Sequence: Synthetic peptide
SFISGSGGSTYYA

SEQ ID NO: 600 - protein, 13 aa, Artificial Sequence
  Description of Artificial Sequence: Synthetic peptide
SAISESGGSTYYA

SEQ ID NO: 601 - protein, 13 aa, Artificial Sequence
  Description of Artificial Sequence: Synthetic peptide
SAITGSGGSTYYG

SEQ ID NO: 602 - protein, 13 aa, Artificial Sequence
  Description of Artificial Sequence: Synthetic peptide
SGISGGGTSTYYA

SEQ ID NO: 603 - protein, 13 aa, Artificial Sequence
  Description of Artificial Sequence: Synthetic peptide
SAISGSVGSTYYA

SEQ ID NO: 604 - protein, 13 aa, Artificial Sequence
  Description of Artificial Sequence: Synthetic peptide
SAISGSGSNIYYA

SEQ ID NO: 605 - protein, 21 aa, Artificial Sequence
  Description of Artificial Sequence: Synthetic peptide
CARVKYLTTSSGWPRPYFDNW

SEQ ID NO: 606 - protein, 16 aa, Artificial Sequence
  Description of Artificial Sequence: Synthetic peptide
CGRSKWPQANGAFDIW

SEQ ID NO: 607 - protein, 18 aa, Artificial Sequence
  Description of Artificial Sequence: Synthetic peptide
CAKDRGYSSSWYGGFDYW

SEQ ID NO: 608 - protein, 17 aa, Artificial Sequence
  Description of Artificial Sequence: Synthetic peptide
CARGTRFLQWSLPLDVW

SEQ ID NO: 609 - protein, 16 aa, Artificial Sequence
  Description of Artificial Sequence: Synthetic peptide
CARHTWWKGAGFFDHW

SEQ ID NO: 610 - protein, 17 aa, Artificial Sequence
  Description of Artificial Sequence: Synthetic peptide
CARGTRFLEWSLPLDVW

SEQ ID NO: 611 - protein, 21 aa, Artificial Sequence
  Description of Artificial Sequence: Synthetic peptide
CARVKYLTTSSGWPRPYFDNW

SEQ ID NO: 612 - protein, 16 aa, Artificial Sequence
  Description of Artificial Sequence: Synthetic peptide
CARHTWWKGAGFFDHW

SEQ ID NO: 613 - protein, 16 aa, Artificial Sequence
  Description of Artificial Sequence: Synthetic peptide
CARHAWWKGAGFFDHW

SEQ ID NO: 614 - protein, 21 aa, Artificial Sequence
  Description of Artificial Sequence: Synthetic peptide
CARVKYLTTSSGWPRPYFDNW

SEQ ID NO: 615 - protein, 16 aa, Artificial Sequence
  Description of Artificial Sequence: Synthetic peptide
CARHTWWKGAGFFDHW

SEQ ID NO: 616 - protein, 18 aa, Artificial Sequence
  Description of Artificial Sequence: Synthetic peptide
CARGLKFLEWLPSAFDIW

SEQ ID NO: 617 - protein, 21 aa, Artificial Sequence
  Description of Artificial Sequence: Synthetic peptide
CARVKYLTTSSGWPRPYFDNW

SEQ ID NO: 618 - protein, 21 aa, Artificial Sequence
  Description of Artificial Sequence: Synthetic peptide
CARVKYLTTSSGWPRPYFDNW

SEQ ID NO: 619 - protein, 16 aa, Artificial Sequence
  Description of Artificial Sequence: Synthetic peptide
CARHTWWKGAGFFDHW

SEQ ID NO: 620 - protein, 18 aa, Artificial Sequence
  Description of Artificial Sequence: Synthetic peptide
CARDAHGYYYDSSGYDDW

SEQ ID NO: 621 - protein, 15 aa, Artificial Sequence
  Description of Artificial Sequence: Synthetic peptide
CAKGVYGSTVTTCHW

SEQ ID NO: 622 - protein, 12 aa, Artificial Sequence
  Description of Artificial Sequence: Synthetic peptide
CARPTNWGFDYW

SEQ ID NO: 623 - protein, 14 aa, Artificial Sequence
  Description of Artificial Sequence: Synthetic peptide
CARADSNWASSAYW

SEQ ID NO: 624 - protein, 19 aa, Artificial Sequence
  Description of Artificial Sequence: Synthetic peptide
CARDPYSYGYYYYYGMDVW

SEQ ID NO: 625 - protein, 13 aa, Artificial Sequence
  Description of Artificial Sequence: Synthetic peptide
CARARNWGPSDYW

SEQ ID NO: 626 - protein, 18 aa, Artificial Sequence
  Description of Artificial Sequence: Synthetic peptide
CARDATYSSSWYNWFDPW

SEQ ID NO: 627 - protein, 12 aa, Artificial Sequence
  Description of Artificial Sequence: Synthetic peptide
CARGTVTSFDFW

SEQ ID NO: 628 - protein, 18 aa, Artificial Sequence
  Description of Artificial Sequence: Synthetic peptide
CAKDYHSASWFSAAADYW

SEQ ID NO: 629 - protein, 18 aa, Artificial Sequence
  Description of Artificial Sequence: Synthetic peptide
CAREGQEYSSGSSYFDYW

SEQ ID NO: 630 - protein, 21 aa, Artificial Sequence
  Description of Artificial Sequence: Synthetic peptide
CARGSQTPYCGGDCPETFDYW

SEQ ID NO: 631 - protein, 16 aa, Artificial Sequence
  Description of Artificial Sequence: Synthetic peptide
CARDLYSSGWYGFDYW

SEQ ID NO: 632 - protein, 20 aa, Artificial Sequence
  Description of Artificial Sequence: Synthetic peptide
CARDNYDFWSGYYTNWFDPW

SEQ ID NO: 633 - protein, 25 aa, Artificial Sequence
  Description of Artificial Sequence: Synthetic peptide
CARDSLSVTMGRGVVTYYYYGMDFW

SEQ ID NO: 634 - protein, 11 aa, Artificial Sequence
  Description of Artificial Sequence: Synthetic peptide
RASQSIRKYLN

SEQ ID NO: 635 - protein, 11 aa, Artificial Sequence
  Description of Artificial Sequence: Synthetic peptide
RASQNIKTYLN

SEQ ID NO: 636 - protein, 11 aa, Artificial Sequence
  Description of Artificial Sequence: Synthetic peptide
RASQTIYSYLN

SEQ ID NO: 637 - protein, 11 aa, Artificial Sequence
  Description of Artificial Sequence: Synthetic peptide
RASRSIRRYLN

SEQ ID NO: 638 - protein, 11 aa, Artificial Sequence
  Description of Artificial Sequence: Synthetic peptide
RASQSIGKYLN

SEQ ID NO: 639 - protein, 11 aa, Artificial Sequence
  Description of Artificial Sequence: Synthetic peptide
RASRSISRYLN

SEQ ID NO: 640 - protein, 11 aa, Artificial Sequence
  Description of Artificial Sequence: Synthetic peptide
RASQSIGKYLN

SEQ ID NO: 641 - protein, 11 aa, Artificial Sequence
  Description of Artificial Sequence: Synthetic peptide
RASQSIGRYLN

SEQ ID NO: 642 - protein, 11 aa, Artificial Sequence
  Description of Artificial Sequence: Synthetic peptide
RASQSIGRYLN

SEQ ID NO: 643 - protein, 11 aa, Artificial Sequence
  Description of Artificial Sequence: Synthetic peptide
RASQSIGKYLN

SEQ ID NO: 644 - protein, 11 aa, Artificial Sequence
  Description of Artificial Sequence: Synthetic peptide
RASQSIGRYLN

SEQ ID NO: 645 - protein, 11 aa, Artificial Sequence
  Description of Artificial Sequence: Synthetic peptide
RTSQSINTYLN

SEQ ID NO: 646 - protein, 11 aa, Artificial Sequence
  Description of Artificial Sequence: Synthetic peptide
RASQSIGKYLN

SEQ ID NO: 647 - protein, 11 aa, Artificial Sequence
  Description of Artificial Sequence: Synthetic peptide
RASQSIGKYLN

SEQ ID NO: 648 - protein, 11 aa, Artificial Sequence
  Description of Artificial Sequence: Synthetic peptide
RASQSIGRYLN

SEQ ID NO: 649 - protein, 11 aa, Artificial Sequence
  Description of Artificial Sequence: Synthetic peptide
RASQIIGSYLN

SEQ ID NO: 650 - protein, 11 aa, Artificial Sequence
  Description of Artificial Sequence: Synthetic peptide
RASQSISRYIN

SEQ ID NO: 651 - protein, 11 aa, Artificial Sequence
  Description of Artificial Sequence: Synthetic peptide
RASQSIYTYLN

SEQ ID NO: 652 - protein, 11 aa, Artificial Sequence
  Description of Artificial Sequence: Synthetic peptide
RASQSIATYLN

SEQ ID NO: 653 - protein, 11 aa, Artificial Sequence
  Description of Artificial Sequence: Synthetic peptide
RASQNINTYLN

SEQ ID NO: 654 - protein, 11 aa, Artificial Sequence
  Description of Artificial Sequence: Synthetic peptide
RASQGIATYLN

SEQ ID NO: 655 - protein, 11 aa, Artificial Sequence
  Description of Artificial Sequence: Synthetic peptide
RASERISNYLN

SEQ ID NO: 656 - protein, 11 aa, Artificial Sequence
  Description of Artificial Sequence: Synthetic peptide
RASQSISSSLN

SEQ ID NO: 657 - protein, 11 aa, Artificial Sequence
  Description of Artificial Sequence: Synthetic peptide
RASQSISSHLN

SEQ ID NO: 658 - protein, 11 aa, Artificial Sequence
  Description of Artificial Sequence: Synthetic peptide
RASQSISSYLI

SEQ ID NO: 659 - protein, 11 aa, Artificial Sequence
  Description of Artificial Sequence: Synthetic peptide
RASPSISTYLN

SEQ ID NO: 660 - protein, 11 aa, Artificial Sequence
  Description of Artificial Sequence: Synthetic peptide
RASQNIAKYLN

SEQ ID NO: 661 - protein, 11 aa, Artificial Sequence
  Description of Artificial Sequence: Synthetic peptide
RASQSIGTYLN

SEQ ID NO: 662 - protein, 11 aa, Artificial Sequence
  Description of Artificial Sequence: Synthetic peptide
RASQSISPYLN

SEQ ID NO: 663 - protein, 7 aa, Artificial Sequence
  Description of Artificial Sequence: Synthetic peptide
ASSTLQR

SEQ ID NO: 664 - protein, 7 aa, Artificial Sequence
  Description of Artificial Sequence: Synthetic peptide
AASKLQS

SEQ ID NO: 665 - protein, 7 aa, Artificial Sequence
  Description of Artificial Sequence: Synthetic peptide
ATSTLQG

SEQ ID NO: 666 - protein, 7 aa, Artificial Sequence
  Description of Artificial Sequence: Synthetic peptide
ASSSLQA

SEQ ID NO: 667 - protein, 7 aa, Artificial Sequence
  Description of Artificial Sequence: Synthetic peptide
ASSSLQS

SEQ ID NO: 668 - protein, 7 aa, Artificial Sequence
  Description of Artificial Sequence: Synthetic peptide
AASSLQA

SEQ ID NO: 669 - protein, 7 aa, Artificial Sequence
  Description of Artificial Sequence: Synthetic peptide
ASSTLQR

SEQ ID NO: 670 - protein, 7 aa, Artificial Sequence
  Description of Artificial Sequence: Synthetic peptide
ASSSLQS

SEQ ID NO: 671 - protein, 7 aa, Artificial Sequence
  Description of Artificial Sequence: Synthetic peptide
AASSLKS

SEQ ID NO: 672 - protein, 7 aa, Artificial Sequence
  Description of Artificial Sequence: Synthetic peptide
ASSTLQR

SEQ ID NO: 673 - protein, 7 aa, Artificial Sequence
  Description of Artificial Sequence: Synthetic peptide
AASSLKS

SEQ ID NO: 674 - protein, 7 aa, Artificial Sequence
  Description of Artificial Sequence: Synthetic peptide
GASNVQS

SEQ ID NO: 675 - protein, 7 aa, Artificial Sequence
  Description of Artificial Sequence: Synthetic peptide
ASSTLQR

SEQ ID NO: 676 - protein, 7 aa, Artificial Sequence
  Description of Artificial Sequence: Synthetic peptide
ASSTLQR

SEQ ID NO: 677 - protein, 7 aa, Artificial Sequence
  Description of Artificial Sequence: Synthetic peptide
AASSLKS

SEQ ID NO: 678 - protein, 7 aa, Artificial Sequence
  Description of Artificial Sequence: Synthetic peptide
TTSNLQS

SEQ ID NO: 679 - protein, 7 aa, Artificial Sequence
  Description of Artificial Sequence: Synthetic peptide
EASSLES

SEQ ID NO: 680 - protein, 7 aa, Artificial Sequence
  Description of Artificial Sequence: Synthetic peptide
SASNLHS

SEQ ID NO: 681 - protein, 7 aa, Artificial Sequence
  Description of Artificial Sequence: Synthetic peptide
GASSLEG

SEQ ID NO: 682 - protein, 7 aa, Artificial Sequence
  Description of Artificial Sequence: Synthetic peptide
SASSLQS

SEQ ID NO: 683 - protein, 7 aa, Artificial Sequence
  Description of Artificial Sequence: Synthetic peptide
YASNLQS

SEQ ID NO: 684 - protein, 7 aa, Artificial Sequence
  Description of Artificial Sequence: Synthetic peptide
TASNLES

SEQ ID NO: 685 - protein, 7 aa, Artificial Sequence
  Description of Artificial Sequence: Synthetic peptide
AASRLQD

SEQ ID NO: 686 - protein, 7 aa, Artificial Sequence
  Description of Artificial Sequence: Synthetic peptide
RASTLQS

SEQ ID NO: 687 - protein, 7 aa, Artificial Sequence
  Description of Artificial Sequence: Synthetic peptide
AASRLHS

SEQ ID NO: 688 - protein, 7 aa, Artificial Sequence
  Description of Artificial Sequence: Synthetic peptide
TASRLQT

SEQ ID NO: 689 - protein, 7 aa, Artificial Sequence
  Description of Artificial Sequence: Synthetic peptide
GASGLQS

SEQ ID NO: 690 - protein, 7 aa, Artificial Sequence
  Description of Artificial Sequence: Synthetic peptide
AASNLHS

SEQ ID NO: 691 - protein, 7 aa, Artificial Sequence
  Description of Artificial Sequence: Synthetic peptide
KASSLQS

SEQ ID NO: 692 - protein, 11 aa, Artificial Sequence [sequence omitted]

SEQ ID NO: 693 - protein, 11 aa, Artificial Sequence [sequence omitted]

SEQ ID NO: 694 - protein, 7 aa, Artificial Sequence [sequence omitted]

SEQ ID NO: 695 - protein, 11 aa, Artificial Sequence [sequence omitted]

SEQ ID NO: 696 - protein, 11 aa, Artificial Sequence [sequence omitted]

SEQ ID NO: 697 - protein, 11 aa, Artificial Sequence [sequence omitted]

SEQ ID NO: 698 - protein, 11 aa, Artificial Sequence
  Description of Artificial Sequence: Synthetic peptide
CQQSLSPPFTF

SEQ ID NO: 699 - protein, 11 aa, Artificial Sequence [sequence omitted]

SEQ ID NO: 700 - protein, 11 aa, Artificial Sequence [sequence omitted]

SEQ ID NO: 701 - protein, 11 aa, Artificial Sequence [sequence omitted]

SEQ ID NO: 702 - protein, 11 aa, Artificial Sequence [sequence omitted]

SEQ ID NO: 703 - protein, 11 aa, Artificial Sequence [sequence omitted]

SEQ ID NO: 704 - protein, 11 aa, Artificial Sequence
  Description of Artificial Sequence: Synthetic peptide
CQQSFSPPFTF

SEQ ID NO: 705 - protein, 11 aa, Artificial Sequence [sequence omitted]

SEQ ID NO: 706 - protein, 11 aa, Artificial Sequence [sequence omitted]

SEQ ID NO: 707 - protein, 11 aa, Artificial Sequence [sequence omitted]

SEQ ID NO: 708 - protein, 11 aa, Artificial Sequence [sequence omitted]

SEQ ID NO: 709 - protein, 11 aa, Artificial Sequence [sequence omitted]

SEQ ID NO: 710 - protein, 11 aa, Artificial Sequence
  Description of Artificial Sequence: Synthetic peptide
CQQTFSSPFTF

SEQ ID NO: 711 - protein, 11 aa, Artificial Sequence
  Description of Artificial Sequence: Synthetic peptide
CQQSSLTPWTF

SEQ ID NO: 712 - protein, 11 aa, Artificial Sequence [sequence omitted]

SEQ ID NO: 713 - protein, 11 aa, Artificial Sequence [sequence omitted]

SEQ ID NO: 714 - protein, 11 aa, Artificial Sequence [sequence omitted]

SEQ ID NO: 715 - protein, 11 aa, Artificial Sequence [sequence omitted]

SEQ ID NO: 716 - protein, 11 aa, Artificial Sequence
  Description of Artificial Sequence: Synthetic peptide
CQQGYNTPRTF

SEQ ID NO: 717 - protein, 11 aa, Artificial Sequence
  Description of Artificial Sequence: Synthetic peptide
CQQTYSTPSSF

SEQ ID NO: 718 - protein, 11 aa, Artificial Sequence
  Description of Artificial Sequence: Synthetic peptide
CQQSHSPPITF

SEQ ID NO: 719 - protein, 11 aa, Artificial Sequence
  Description of Artificial Sequence: Synthetic peptide
CQESYSAPYTF

SEQ ID NO: 720 - protein, 11 aa, Artificial Sequence [sequence omitted]

SEQ ID NO: 721 - protein, 126 aa, Artificial Sequence
  Description of Artificial Sequence: Synthetic polypeptide
EVQLLESGGGLVQPGGSLRLSCAASGFTFRSHAMSWVRQAPGKGLEWVSSISGGGASTYYADSVKGRFTISRDNSKNTLYLQMNSLRAEDTAVYYCARVKYLTTSSGWPRPYFDNWGQGTLVTVSS

SEQ ID NO: 722 - protein, 121 aa, Artificial Sequence
  Description of Artificial Sequence: Synthetic polypeptide
EVQLLESGGGLVQPGGSLRLSCAASGFTFSAYSMSWVRQAPGKGLEWVSAISGSGGSRYYADSVKGRFTISRDNSKNTLYLQMNSLRAEDTAVYYCGRSKWPQANGAFDIWGQGTLVTVSS

SEQ ID NO: 723 - protein, 123 aa, Artificial Sequence
  Description of Artificial Sequence: Synthetic polypeptide
EVQLLESGGGLVQPGGSLRLSCAASGFMFGNYAMSWVRQAPGKGLEWVAAISGSGGSTYYADSVKGRFTISRDNSKNTLYLQMNSLRAEDTAVYYCAKDRGYSSSWYGGFDYWGQGTLVTVSS

SEQ ID NO: 724 - protein, 122 aa, Artificial Sequence
  Description of Artificial Sequence: Synthetic polypeptide
EVQLLESGGGLVQPGGSLRLSCAASGFTFRNHAMAWVRQAPGKGLEWVSGISGSGGTTYYGDSVKGRFTISRDNSKNTLYLQMNSLRAEDTAVYYCARGTRFLQWSLPLDVWGQGTLVTVSS

SEQ ID NO: 725 - protein, 121 aa, Artificial Sequence
  Description of Artificial Sequence: Synthetic polypeptide
EVQLLESGGGLVQPGGSLRLSCAASGFTIPNYAMSWVRQAPGKGLEWVSGISGAGASTYYADSVKGRFTISRDNSKNTLYLQMNSLRAEDTAVYYCARHTWWKGAGFFDHWGQGTLVTVSS

SEQ ID NO: 726 - protein, 122 aa, Artificial Sequence
  Description of Artificial Sequence: Synthetic polypeptide
EVQLLESGGGLVQPGGSLRLSCAASGFTFRNYAMAWVRQAPGKGLEWVSGISGSGGTTYYGDSVKGRFTISRDNSKNTLYLQMNSLRAEDTAVYYCARGTRFLEWSLPLDVWGQGTLVTVSS

SEQ ID NO: 727 - protein, 126 aa, Artificial Sequence
  Description of Artificial Sequence: Synthetic polypeptide
EVQLLESGGGLVQPGGSLRLSCAASGFTIRNYAMSWVRQAPGKGLEWVSSISGGGASTYYADSVKGRFTISRDNSKNTLYLQMNSLRAEDTAVYYCARVKYLTTSSGWPRPYFDNWGQGTLVTVSS

SEQ ID NO: 728 - protein, 121 aa, Artificial Sequence
  Description of Artificial Sequence: Synthetic polypeptide
EVQLLESGGGLVQPGGSLRLSCAASGFTIPNYAMSWVRQAPGKGLEWVSGISGSGASTYYADSVKGRFTISRDNSKNTLYLQMNSLRAEDTAVYYCARHTWWKGAGFFDHWGQGTLVTVSS

SEQ ID NO: 729 - protein, 121 aa, Artificial Sequence
  Description of Artificial Sequence: Synthetic polypeptide
EVQLLESGGGLVQPGGSLRLSCAASGFTITNYAMSWVRQAPGKGLEWVSGISGSGAGTYYADSVKGRFTISRDNSKNTLYLQMNSLRAEDTAVYYCARHAWWKGAGFFDHWGQGTLVTVSS

SEQ ID NO: 730 - protein, 126 aa, Artificial Sequence; identical to SEQ ID NO: 721
  Description of Artificial Sequence: Synthetic polypeptide

SEQ ID NO: 731 - protein, 121 aa, Artificial Sequence
  Description of Artificial Sequence: Synthetic polypeptide
EVQLLESGGGLVQPGGSLRLSCAASGFTITNYAMSWVRQAPGKGLEWVSGISGSGASTYYADSVKGRFTISRDNSKNTLYLQMNSLRAEDTAVYYCARHTWWKGAGFFDHWGQGTLVTVSS

SEQ ID NO: 732 - protein, 123 aa, Artificial Sequence
  Description of Artificial Sequence: Synthetic polypeptide
EVQLLESGGGLVQPGGSLRLSCAASGFTFRSHAMNWVRQAPGKGLEWVSAISGSGGSTNYADSVKGRFTISRDNSKNTLYLQMNSLRAEDTAVYYCARGLKFLEWLPSAFDIWGQGTLVTVSS

SEQ ID NO: 733 - protein, 126 aa, Artificial Sequence; identical to SEQ ID NO: 721
  Description of Artificial Sequence: Synthetic polypeptide

SEQ ID NO: 734 - protein, 126 aa, Artificial Sequence
  Description of Artificial Sequence: Synthetic polypeptide
EVQLLESGGGLVQPGGSLRLSCAASGFTFRSYAMSWVRQAPGKGLEWVSSISGGGASTYYADSVKGRFTISRDNSKNTLYLQMNSLRAEDTAVYYCARVKYLTTSSGWPRPYFDNWGQGTLVTVSS

SEQ ID NO: 735 - protein, 121 aa, Artificial Sequence
  Description of Artificial Sequence: Synthetic polypeptide
EVQLLESGGGLVQPGGSLRLSCAASGFTITNYAMSWVRQAPGKGLEWVSGISGSGAGTYYADSVKGRFTISRDNSKNTLYLQMNSLRAEDTAVYYCARHTWWKGAGFFDHWGQGTLVTVSS

SEQ ID NO: 736 - protein, 123 aa, Artificial Sequence
  Description of Artificial Sequence: Synthetic polypeptide
EVQLLESGGGLVQPGGSLRLSCAASGFTFTNFAMSWVRQAPGKGLEWVSAISGRGGGTYYADSVKGRFTISRDNSKNTLYLQMNSLRAEDTAVYYCARDAHGYYYDSSGYDDWGQGTLVTVSS

SEQ ID NO: 737 - protein, 120 aa, Artificial Sequence
  Description of Artificial Sequence: Synthetic polypeptide
EVQLLESGGGLVQPGGSLRLSCAASGFTFRSYPMSWVRQAPGKGLEWVSTISGSGGITYYADSVKGRFTISRDNSKNTLYLQMNSLRAEDTAVYYCAKGVYGSTVTTCHWGQGTLVTVSS

SEQ ID NO: 738 - protein, 117 aa, Artificial Sequence
  Description of Artificial Sequence: Synthetic polypeptide
EVQLLESGGGLVQPGGSLRLSCAASGFTLTSYAMSWVRQAPGKGLEWVSAISGSGVDTYYADSVKGRFTISRDNSKNTLYLQMNSLRAEDTAVYYCARPTNWGFDYWGQGTLVTVSS

SEQ ID NO: 739 - protein, 119 aa, Artificial Sequence
  Description of Artificial Sequence: Synthetic polypeptide
EVQLLESGGGLVQPGGSLRLSCAASGFTFINYAMSWVRQAPGKGLEWVSTISTSGGNTYYADSVKGRFTISRDNSKNTLYLQMNSLRAEDTAVYYCARADSNWASSAYWGQGTLVTVSS

SEQ ID NO: 740 - protein, 124 aa, Artificial Sequence
  Description of Artificial Sequence: Synthetic polypeptide
EVQLLESGGGLVQPGGSLRLSCAASGFPFSTYAMSWVRQAPGKGLEWVSGISVSGGFTYYADSVKGRFTISRDNSKNTLYLQMNSLRAEDTAVYYCARDPYSYGYYYYYGMDVWGQGTLVTVSS

SEQ ID NO: 741 - protein, 118 aa, Artificial Sequence
  Description of Artificial Sequence: Synthetic polypeptide
EVQLLESGGGLVQPGGSLRLSCAASGFTFSTYAMGWVRQAPGKGLEWVSGISGGGVSTYYADSVKGRFTISRDNSKNTLYLQMNSLRAEDTAVYYCARARNWGPSDYWGQGTLVTVSS

SEQ ID NO: 742 - protein, 120 aa, Artificial Sequence
  Description of Artificial Sequence: Synthetic polypeptide
EVQLLESGGGLVQPGGSLRLSCAASGFIFSDYAMTWVRQAPGKGLEWVSAISGSAFYADSVKGRFTISRDNSKNTLYLQMNSLRAEDTAVYYCARDATYSSSWYNWFDPWGQGTLVTVSS

SEQ ID NO: 743 - protein, 117 aa, Artificial Sequence
  Description of Artificial Sequence: Synthetic polypeptide
EVQLLESGGGLVQPGGSLRLSCAASGFTFSDYAMTWVRQAPGKGLEWVSDISGSGGSTYYADSVKGRFTISRDNSKNTLYLQMNSLRAEDTAVYYCARGTVTSFDFWGQGTLVTVSS

SEQ ID NO: 744 - protein, 123 aa, Artificial Sequence
  Description of Artificial Sequence: Synthetic polypeptide
EVQLLESGGGLVQPGGSLRLSCAASGFTFSIYAMGWVRQAPGKGLEWVSFISGSGGSTYYADSVKGRFTISRDNSKNTLYLQMNSLRAEDTAVYYCAKDYHSASWFSAAADYWGQGTLVTVSS

SEQ ID NO: 745 - protein, 123 aa, Artificial Sequence
  Description of Artificial Sequence: Synthetic polypeptide
EVQLLESGGGLVQPGGSLRLSCAASGFTFASYAMTWVRQAPGKGLEWVSAISESGGSTYYADSVKGRFTISRDNSKNTLYLQMNSLRAEDTAVYYCAREGQEYSSGSSYFDYWGQGTLVTVSS

SEQ ID NO: 746 - protein, 126 aa, Artificial Sequence
  Description of Artificial Sequence: Synthetic polypeptide
EVQLLESGGGLVQPGGSLRLSCAASGFTFSEYAMSWVRQAPGKGLEWVSAITGSGGSTYYGDSVKGRFTISRDNSKNTLYLQMNSLRAEDTAVYYCARGSQTPYCGGDCPETFDYWGQGTLVTVSS

SEQ ID NO: 747 - protein, 121 aa, Artificial Sequence
  Description of Artificial Sequence: Synthetic polypeptide
EVQLLESGGGLVQPGGSLRLSCAASGFTFDDYAMSWVRQAPGKGLEWVSGISGGGTSTYYADSVKGRFTISRDNSKNTLYLQMNSLRAEDTAVYYCARDLYSSGWYGFDYWGQGTLVTVSS

SEQ ID NO: 748 - protein, 125 aa, Artificial Sequence
  Description of Artificial Sequence: Synthetic polypeptide
EVQLLESGGGLVQPGGSLRLSCAASGFTFNNYAMNWVRQAPGKGLEWVSAISGSVGSTYYADSVKGRFTISRDNSKNTLYLQMNSLRAEDTAVYYCARDNYDFWSGYYTNWFDPWGQGTLVTVSS

SEQ ID NO: 749 - protein, 130 aa, Artificial Sequence
  Description of Artificial Sequence: Synthetic polypeptide
EVQLLESGGGLVQPGGSLRLSCAASGFTFTNHAMSWVRQAPGKGLEWVSAISGSGSNIYYADSVKGRFTISRDNSKNTLYLQMNSLRAEDTAVYYCARDSLSVTMGRGVVTYYYYGMDFWGQGTLVTVSS

SEQ ID NO: 750 - protein, 107 aa, Artificial Sequence
  Description of Artificial Sequence: Synthetic polypeptide
DIQMTQSPSSLSASVGDRVTITCRASQSIRKYLNWYQQKPGKAPKLLIYASSTLQRGVPSRFSGSGSGTDFTLTISSLQPEDFATYYCQQSLSTPFTFGGGTKVEIK

SEQ ID NO: 751 - protein, 107 aa, Artificial Sequence
  Description of Artificial Sequence: Synthetic polypeptide
DIQMTQSPSSLSASVGDRVTITCRASRSIRRYLNWYQQKPGKAPKLLIYASSSLQAGVPSRFSGSGSGTDFTLTISSLQPEDFATYYCQQSYSTLLTFGQGTKVEIK

SEQ ID NO: 752 - protein, 107 aa, Artificial Sequence
  Description of Artificial Sequence: Synthetic polypeptide
DIQMTQSPSSLSASVGDRVTITCRASQSIGRYLNWYQQKPGKAPKLLIYASSSLQSGVPSRFSGSGSGTDFTLTISSLQPEDFATYYCQQSYSLPRTFGQGTKVEIK

SEQ ID NO: 753 - protein, 103 aa, Artificial Sequence
  Description of Artificial Sequence: Synthetic polypeptide
DIQMTQSPSSLSASVGDRVTITCRASQTIYSYLNWYQQKPGKAPKLLIYATSTLQGGVPSRFSGSGSGTDFTLTISSLQPEDFATYYCQHRGTFGQGTKVEIK

SEQ ID NO: 754 - protein, 107 aa, Artificial Sequence
  Description of Artificial Sequence: Synthetic polypeptide
DIQMTQSPSSLSASVGDRVTITCRASQSIGRYLNWYQQKPGKAPKLLIYAASSLKSGVPSRFSGSGSGTDFTLTISSLQPEDFATYYCQQSYSLPRTFGQGTKVEIK

SEQ ID NO: 755 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSSLQSGVPSRFSGSGSGTDFTLTISSLQPEDFATYYCQQSYSPPFTFGQGTKVEIK

SEQ ID NO: 756 - protein, 107 aa, Artificial Sequence
  Description of Artificial Sequence: Synthetic polypeptide
DIQMTQSPSSLSASVGDRVTITCRASQNIKTYLNWYQQKPGKAPKLLIYAASKLQSGVPSRFSGSGSGTDFTLTISSLQPEDFATYYCQQSYSTSPTFGQGTKVEIK

SEQ ID NO: 757 - protein, 107 aa, Artificial Sequence
  Description of Artificial Sequence: Synthetic polypeptide
DIQMTQSPSSLSASVGDRVTITCRASRSISRYLNWYQQKPGKAPKLLIYAASSLQAGVPSRFSGSGSGTDFTLTISSLQPEDFATYYCQQSYSSLLTFGQGTKVEIK

SEQ ID NO: 758 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSLSPPFTFGQGTKVEIK

SEQ ID NO: 759 - protein, 107 aa, Artificial Sequence
  Description of Artificial Sequence: Synthetic polypeptide
DIQMTQSPSSLSASVGDRVTITCRASQSIGRYLNWYQQKPGKAPKLLIYAASSLKSGVPSRFSGSGSGTDFTLTISSLQPEDFATYYCQQSYSLPLTFGQGTKVEIK

SEQ ID NO: 760 - protein, 107 aa, Artificial Sequence
  Description of Artificial Sequence: Synthetic polypeptide
DIQMTQSPSSLSASVGDRVTITCRTSQSINTYLNWYQQKPGKAPKLLIYGASNVQSGVPSRFSGSGSGTDFTLTISSLQPEDFATYYCQQSYRIPRTFGQGTKVEIK

SEQ ID NO: 761 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSLSTPFTFGQGTKVEIK

SEQ ID NO: 762 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSFSTPFTFGQGTKVEIK

SEQ ID NO: 763 - protein, 107 aa, Artificial Sequence; identical to SEQ ID NO: 754
  Description of Artificial Sequence: Synthetic polypeptide

SEQ ID NO: 764 - protein, 107 aa, Artificial Sequence
  Description of Artificial Sequence: Synthetic polypeptide
DIQMTQSPSSLSASVGDRVTITCRASQSIGKYLNWYQQKPGKAPKLLIYASSTLQRGVPSRFSGSGSGTDFTLTISSLQPEDFATYYCQQSFSPPFTFGQGTKVEIK

SEQ ID NO: 765 - protein, 107 aa, Artificial Sequence
  Description of Artificial Sequence: Synthetic polypeptide
DIQMTQSPSSLSASVGDRVTITCRASQIIGSYLNWYQQKPGKAPKLLIYTTSNLQSGVPSRFSGSGSGTDFTLTISSLQPEDFATYYCQQSYITPWTFGQGTKVEIK

SEQ ID NO: 766 - protein, 107 aa, Artificial Sequence
  Description of Artificial Sequence: Synthetic polypeptide
DIQMTQSPSSLSASVGDRVTITCRASQSISRYINWYQQKPGKAPKLLIYEASSLESGVPSRFSGSGSGTDFTLTISSLQPEDFATYYCQQSHITPLTFGQGTKVEIK

SEQ ID NO: 767 - protein, 107 aa, Artificial Sequence
  Description of Artificial Sequence: Synthetic polypeptide
DIQMTQSPSSLSASVGDRVTITCRASQSIYTYLNWYQQKPGKAPKLLIYSASNLHSGVPSRFSGSGSGTDFTLTISSLQPEDFATYYCQQSDTTPWTFGQGTKVEIK

SEQ ID NO: 768 - protein, 107 aa, Artificial Sequence
  Description of Artificial Sequence: Synthetic polypeptide
DIQMTQSPSSLSASVGDRVTITCRASQSIATYLNWYQQKPGKAPKLLIYGASSLEGGVPSRFSGSGSGTDFTLTISSLQPEDFATYYCQQTFSSPFTFGQGTKVEIK

SEQ ID NO: 769 - protein, 107 aa, Artificial Sequence
  Description of Artificial Sequence: Synthetic polypeptide
DIQMTQSPSSLSASVGDRVTITCRASQNINTYLNWYQQKPGKAPKLLIYSASSLQSGVPSRFSGSGSGTDFTLTISSLQPEDFATYYCQQSSLTPWTFGQGTKVEIK

SEQ ID NO: 770 - protein, 107 aa, Artificial Sequence
  Description of Artificial Sequence: Synthetic polypeptide
DIQMTQSPSSLSASVGDRVTITCRASQGIATYLNWYQQKPGKAPKLLIYYASNLQSGVPSRFSGSGSGTDFTLTISSLQPEDFATYYCQQSYSTRFTFGQGTKVEIK

SEQ ID NO: 771 - protein, 107 aa, Artificial Sequence
  Description of Artificial Sequence: Synthetic polypeptide
DIQMTQSPSSLSASVGDRVTITCRASERISNYLNWYQQKPGKAPKLLIYTASNLESGVPSRFSGSGSGTDFTLTISSLQPEDFATYYCQQSYTPPRTFGQGTKVEIK

SEQ ID NO: 772 - protein, 107 aa, Artificial Sequence
  Description of Artificial Sequence: Synthetic polypeptide
DIQMTQSPSSLSASVGDRVTITCRASQSISSSLNWYQQKPGKAPKLLIYAASRLQDGVPSRFSGSGSGTDFTLTISSLQPEDFATYYCQQSYSTPRSFGQGTKVEIK

SEQ ID NO: 773 - protein, 107 aa, Artificial Sequence
  Description of Artificial Sequence: Synthetic polypeptide
DIQMTQSPSSLSASVGDRVTITCRASQSISSHLNWYQQKPGKAPKLLIYRASTLQSGVPSRFSGSGSGTDFTLTISSLQPEDFATYYCQQTYNTPQTFGQGTKVEIK

SEQ ID NO: 774 - protein, 107 aa, Artificial Sequence
  Description of Artificial Sequence: Synthetic polypeptide
DIQMTQSPSSLSASVGDRVTITCRASQSISSYLIWYQQKPGKAPKLLIYAASRLHSGVPSRFSGSGSGTDFTLTISSLQPEDFATYYCQQGYNTPRTFGQGTKVEIK

SEQ ID NO: 775 - protein, 107 aa, Artificial Sequence
  Description of Artificial Sequence: Synthetic polypeptide
DIQMTQSPSSLSASVGDRVTITCRASPSISTYLNWYQQKPGKAPKLLIYTASRLQTGVPSRFSGSGSGTDFTLTISSLQPEDFATYYCQQTYSTPSSFGQGTKVEIK

SEQ ID NO: 776 - protein, 107 aa, Artificial Sequence
  Description of Artificial Sequence: Synthetic polypeptide
DIQMTQSPSSLSASVGDRVTITCRASQNIAKYLNWYQQKPGKAPKLLIYGASGLQSGVPSRFSGSGSGTDFTLTISSLQPEDFATYYCQQSHSPPITFGQGTKVEIK

SEQ ID NO: 777 - protein, 107 aa, Artificial Sequence
  Description of Artificial Sequence: Synthetic polypeptide
DIQMTQSPSSLSASVGDRVTITCRASQSIGTYLNWYQQKPGKAPKLLIYAASNLHSGVPSRFSGSGSGTDFTLTISSLQPEDFATYYCQESYSAPYTFGQGTKVEIK

SEQ ID NO: 778 - protein, 107 aa, Artificial Sequence
  Description of Artificial Sequence: Synthetic polypeptide
DIQMTQSPSSLSASVGDRVTITCRASQSISPYLNWYQQKPGKAPKLLIYKASSLQSGVPSRFSGSGSGTDFTLTISSLQPEDFATYYCQQSSSTPYTFGQGTKVEIK

SEQ ID NO: 779 - protein, 7 aa, Artificial Sequence
  Description of Artificial Sequence: Synthetic peptide
PGTAIMG

SEQ ID NO: 780 - protein, 9 aa, Artificial Sequence
  Description of Artificial Sequence: Synthetic peptide
RSFSNSVMG

SEQ ID NO: 781 - protein, 9 aa, Artificial Sequence
  Description of Artificial Sequence: Synthetic peptide
RTFGDDTMG

SEQ ID NO: 782 - protein, 9 aa, Artificial Sequence
  Description of Artificial Sequence: Synthetic peptide
RTFSDARMG

SEQ ID NO: 783 - protein, 9 aa, Artificial Sequence
  Description of Artificial Sequence: Synthetic peptide
RTFGDYIMG

SEQ ID NO: 784 - protein, 9 aa, Artificial Sequence
  Description of Artificial Sequence: Synthetic peptide
SGLSINAMG

SEQ ID NO: 785 - protein, 9 aa, Artificial Sequence
  Description of Artificial Sequence: Synthetic peptide
RTFSNAAMG

SEQ ID NO: 786 - protein, 9 aa, Artificial Sequence
  Description of Artificial Sequence: Synthetic peptide
FSLDYYGMG

SEQ ID NO: 787 - protein, 9 aa, Artificial Sequence
  Description of Artificial Sequence: Synthetic peptide
FTFSRHDMG

SEQ ID NO: 788 - protein, 9 aa, Artificial Sequence
  Description of Artificial Sequence: Synthetic peptide
LTFRNYAMG

SEQ ID NO: 789 - protein, 9 aa, Artificial Sequence
  Description of Artificial Sequence: Synthetic peptide
GTFSRYAMG

SEQ ID NO: 790 - protein, 9 aa, Artificial Sequence
  Description of Artificial Sequence: Synthetic peptide
FTLDYYDMG

SEQ ID NO: 791 - protein, 9 aa, Artificial Sequence
  Description of Artificial Sequence: Synthetic peptide
RTFGDYIMG

SEQ ID NO: 792 - protein, 9 aa, Artificial Sequence
  Description of Artificial Sequence: Synthetic peptide
RTFGDDIMG

SEQ ID NO: 793 - protein, 9 aa, Artificial Sequence
  Description of Artificial Sequence: Synthetic peptide
RTFGDYIMG

SEQ ID NO: 794 - protein, 9 aa, Artificial Sequence
  Description of Artificial Sequence: Synthetic peptide
RTFGDYIMG

SEQ ID NO: 795 - protein, 9 aa, Artificial Sequence
  Description of Artificial Sequence: Synthetic peptide
RTFSDDTMG

SEQ ID NO: 796 - protein, 9 aa, Artificial Sequence
  Description of Artificial Sequence: Synthetic peptide
RTFGDDTMG

SEQ ID NO: 797 - protein, 9 aa, Artificial Sequence
  Description of Artificial Sequence: Synthetic peptide
RTFGDYIMG

SEQ ID NO: 798 - protein, 9 aa, Artificial Sequence
  Description of Artificial Sequence: Synthetic peptide
RTFGDDTMG

SEQ ID NO: 799 - protein, 9 aa, Artificial Sequence
  Description of Artificial Sequence: Synthetic peptide
RTFSDYTMG

SEQ ID NO: 800 - protein, 9 aa, Artificial Sequence
  Description of Artificial Sequence: Synthetic peptide
RTFGDYGMG

SEQ ID NO: 801 - protein, 9 aa, Artificial Sequence
  Description of Artificial Sequence: Synthetic peptide
RTFSDDTMG

SEQ ID NO: 802 - protein, 9 aa, Artificial Sequence
  Description of Artificial Sequence: Synthetic peptide
RTFSDDIMG

SEQ ID NO: 803 - protein, 9 aa, Artificial Sequence
  Description of Artificial Sequence: Synthetic peptide
RTFGDYIMG

SEQ ID NO: 804 - protein, 10 aa, Artificial Sequence
  Description of Artificial Sequence: Synthetic peptide
FTFDDDYVMG

SEQ ID NO: 805 - protein, 9 aa, Artificial Sequence
  Description of Artificial Sequence: Synthetic peptide
RTFGDYIMG

SEQ ID NO: 806 - protein, 9 aa, Artificial Sequence
  Description of Artificial Sequence: Synthetic peptide
RTFGDYIMG

SEQ ID NO: 807 - protein, 9 aa, Artificial Sequence
  Description of Artificial Sequence: Synthetic peptide
RTFGDDTMG

SEQ ID NO: 808 - protein, 9 aa, Artificial Sequence
  Description of Artificial Sequence: Synthetic peptide
RTFSDDTMG

SEQ ID NO: 809 - protein, 9 aa, Artificial Sequence
  Description of Artificial Sequence: Synthetic peptide
RTFSDDTMG

SEQ ID NO: 810 - protein, 9 aa, Artificial Sequence
  Description of Artificial Sequence: Synthetic peptide
RTFSDDTMG

SEQ ID NO: 811 - protein, 9 aa, Artificial Sequence
  Description of Artificial Sequence: Synthetic peptide
RTFSDDAMG

SEQ ID NO: 812 - protein, 9 aa, Artificial Sequence
  Description of Artificial Sequence: Synthetic peptide
RTFSDDTMG

SEQ ID NO: 813 - protein, 9 aa, Artificial Sequence
  Description of Artificial Sequence: Synthetic peptide
RTFGDYIMG

SEQ ID NO: 814 - protein, 9 aa, Artificial Sequence
  Description of Artificial Sequence: Synthetic peptide
RTFGDDTMG

SEQ ID NO: 815 - protein, 9 aa, Artificial Sequence
  Description of Artificial Sequence: Synthetic peptide
RTFSDDAMG

SEQ ID NO: 816 - protein, 9 aa, Artificial Sequence
  Description of Artificial Sequence: Synthetic peptide
RTFGDYIMG

SEQ ID NO: 817 - protein, 9 aa, Artificial Sequence
  Description of Artificial Sequence: Synthetic peptide
RTFSDDTMG

SEQ ID NO: 818 - protein, 9 aa, Artificial Sequence
  Description of Artificial Sequence: Synthetic peptide
RTFSDDAMG

SEQ ID NO: 819 - protein, 9 aa, Artificial Sequence
  Description of Artificial Sequence: Synthetic peptide
FTFDDYEMG

SEQ ID NO: 820 - protein, 9 aa, Artificial Sequence
  Description of Artificial Sequence: Synthetic peptide
RTFGDDTMG

SEQ ID NO: 821 - protein, 9 aa, Artificial Sequence
  Description of Artificial Sequence: Synthetic peptide
RTFSDDAMG

SEQ ID NO: 822 - protein, 9 aa, Artificial Sequence
  Description of Artificial Sequence: Synthetic peptide
VTLDDYAMG

SEQ ID NO: 823 - protein, 9 aa, Artificial Sequence
  Description of Artificial Sequence: Synthetic peptide
RTFGDYIMG

SEQ ID NO: 824 - protein, 9 aa, Artificial Sequence
  Description of Artificial Sequence: Synthetic peptide
LTFSDDTMG

SEQ ID NO: 825 - protein, 9 aa, Artificial Sequence
  Description of Artificial Sequence: Synthetic peptide
RTFGDDTMG

SEQ ID NO: 826 - protein, 9 aa, Artificial Sequence
  Description of Artificial Sequence: Synthetic peptide
RTFGDYIMG

SEQ ID NO: 827 - protein, 9 aa, Artificial Sequence
  Description of Artificial Sequence: Synthetic peptide
RTFGDDTMG

SEQ ID NO: 828 - protein, 9 aa, Artificial Sequence
  Description of Artificial Sequence: Synthetic peptide
RTFGDYTMG

SEQ ID NO: 829 - protein, 9 aa, Artificial Sequence
  Description of Artificial Sequence: Synthetic peptide
RTFSDDTMG

SEQ ID NO: 830 - protein, 9 aa, Artificial Sequence
  Description of Artificial Sequence: Synthetic peptide
RTFGDYAMG

SEQ ID NO: 831 - protein, 9 aa, Artificial Sequence
  Description of Artificial Sequence: Synthetic peptide
GTFSNSGMG

SEQ ID NO: 832 - protein, 11 aa, Artificial Sequence
  Description of Artificial Sequence: Synthetic peptide
QLANFASYAMG

SEQ ID NO: 833 - protein, 9 aa, Artificial Sequence
  Description of Artificial Sequence: Synthetic peptide
RTFSDDIMG

SEQ ID NO: 834 - protein, 9 aa, Artificial Sequence
  Description of Artificial Sequence: Synthetic peptide
RTFGDYIMG

SEQ ID NO: 835 - protein, 9 aa, Artificial Sequence
  Description of Artificial Sequence: Synthetic peptide
RTFSDDTMG

SEQ ID NO: 836 - protein, 9 aa, Artificial Sequence
  Description of Artificial Sequence: Synthetic peptide
RTFSDDTMG

SEQ ID NO: 837 - protein, 9 aa, Artificial Sequence
  Description of Artificial Sequence: Synthetic peptide
RTFGDYIMG

SEQ ID NO: 838 - protein, 9 aa, Artificial Sequence
  Description of Artificial Sequence: Synthetic peptide
RTFGDYIMG

SEQ ID NO: 839 - protein, 9 aa, Artificial Sequence
  Description of Artificial Sequence: Synthetic peptide
RTFSDDTMG

SEQ ID NO: 840 - protein, 9 aa, Artificial Sequence
  Description of Artificial Sequence: Synthetic peptide
RTFGDYAMG

SEQ ID NO: 841 - protein, 9 aa, Artificial Sequence
  Description of Artificial Sequence: Synthetic peptide
RTFGDDTMG

SEQ ID NO: 842 - protein, 9 aa, Artificial Sequence
  Description of Artificial Sequence: Synthetic peptide
RTFGDYIMG

SEQ ID NO: 843 - protein, 9 aa, Artificial Sequence
  Description of Artificial Sequence: Synthetic peptide
RTFGDYIMG

SEQ ID NO: 844 - protein, 9 aa, Artificial Sequence
  Description of Artificial Sequence: Synthetic peptide
RTFSDDTMG

SEQ ID NO: 845 - protein, 9 aa, Artificial Sequence
  Description of Artificial Sequence: Synthetic peptide
RTFGDYIMG

SEQ ID NO: 846 - protein, 9 aa, Artificial Sequence
  Description of Artificial Sequence: Synthetic peptide
RTFSDDTMG

SEQ ID NO: 847 - protein, 9 aa, Artificial Sequence
  Description of Artificial Sequence: Synthetic peptide
RTFSDYTMG

SEQ ID NO: 848 - protein, 9 aa, Artificial Sequence
  Description of Artificial Sequence: Synthetic peptide
RTFGDDTMG

SEQ ID NO: 849 - protein, 9 aa, Artificial Sequence
  Description of Artificial Sequence: Synthetic peptide
FAFGDNWIG

SEQ ID NO: 850 - protein, 9 aa, Artificial Sequence
  Description of Artificial Sequence: Synthetic peptide
RTFSDDAMG

SEQ ID NO: 851 - protein, 9 aa, Artificial Sequence
  Description of Artificial Sequence: Synthetic peptide
RTFSDDTMG

SEQ ID NO: 852 - protein, 9 aa, Artificial Sequence
  Description of Artificial Sequence: Synthetic peptide
RTFSDDTMG

SEQ ID NO: 853 - protein, 9 aa, Artificial Sequence
  Description of Artificial Sequence: Synthetic peptide
RTFGDDTMG

SEQ ID NO: 854 - protein, 9 aa, Artificial Sequence
  Description of Artificial Sequence: Synthetic peptide
RTFGDYIMG

SEQ ID NO: 855 - protein, 9 aa, Artificial Sequence
  Description of Artificial Sequence: Synthetic peptide
RTFSDDAMG

SEQ ID NO: 856 - protein, 9 aa, Artificial Sequence
  Description of Artificial Sequence: Synthetic peptide
RTFGDYIMG

SEQ ID NO: 857 - protein, 9 aa, Artificial Sequence
  Description of Artificial Sequence: Synthetic peptide
RTFGDDTMG

SEQ ID NO: 858 - protein, 9 aa, Artificial Sequence
  Description of Artificial Sequence: Synthetic peptide
RTFSDDTMG

SEQ ID NO: 859 - protein, 9 aa, Artificial Sequence
  Description of Artificial Sequence: Synthetic peptide
RTFGDYIMG

SEQ ID NO: 860 - protein, 9 aa, Artificial Sequence
  Description of Artificial Sequence: Synthetic peptide
FTFGDYVMG

SEQ ID NO: 861 - protein, 9 aa, Artificial Sequence
  Description of Artificial Sequence: Synthetic peptide
RTFGDYTMG

SEQ ID NO: 862 - protein, 9 aa, Artificial Sequence
  Description of Artificial Sequence: Synthetic peptide
RTFGDYIMG

SEQ ID NO: 863 - protein, 9 aa, Artificial Sequence
  Description of Artificial Sequence: Synthetic peptide
RTFGDYIMG

SEQ ID NO: 864 - protein, 9 aa, Artificial Sequence
  Description of Artificial Sequence: Synthetic peptide
RTFGDYIMG

SEQ ID NO: 865 - protein, 9 aa, Artificial Sequence
  Description of Artificial Sequence: Synthetic peptide
RTFGDYIMG

SEQ ID NO: 866 - protein, 9 aa, Artificial Sequence
  Description of Artificial Sequence: Synthetic peptide
FTWGDYTMG

SEQ ID NO: 867 - protein, 9 aa, Artificial Sequence
  Description of Artificial Sequence: Synthetic peptide
IPSTLRAMG

SEQ ID NO: 868 - protein, 10 aa, Artificial Sequence
  Description of Artificial Sequence: Synthetic peptide
FSFDDDYVMG

SEQ ID NO: 869 - protein, 9 aa, Artificial Sequence
  Description of Artificial Sequence: Synthetic peptide
RTFSNAAMG

SEQ ID NO: 870 - protein, 9 aa, Artificial Sequence
  Description of Artificial Sequence: Synthetic peptide
GTFGVYHMG

SEQ ID NO: 871 - protein, 9 aa, Artificial Sequence
  Description of Artificial Sequence: Synthetic peptide
FTFSSYYMG

SEQ ID NO: 872 - protein, 9 aa, Artificial Sequence
  Description of Artificial Sequence: Synthetic peptide
RTFSGDFMG

SEQ ID NO: 873 - protein, 9 aa, Artificial Sequence
  Description of Artificial Sequence: Synthetic peptide
STLRDYAMG

SEQ ID NO: 874 - protein, 9 aa, Artificial Sequence
  Description of Artificial Sequence: Synthetic peptide
FTFDDYTMG

SEQ ID NO: 875 - protein, 9 aa, Artificial Sequence
  Description of Artificial Sequence: Synthetic peptide
GTFSSYGMG

SEQ ID NO: 876 - protein, 10 aa, Artificial Sequence
  Description of Artificial Sequence: Synthetic peptide
FSFDDDYVMG

SEQ ID NO: 877 - protein, 10 aa, Artificial Sequence
  Description of Artificial Sequence: Synthetic peptide
FSFDDDYVMG

SEQ ID NO: 878 - protein, 9 aa, Artificial Sequence
  Description of Artificial Sequence: Synthetic peptide
NIAAINVMG

SEQ ID NO: 879 - protein, 9 aa, Artificial Sequence
  Description of Artificial Sequence: Synthetic peptide
IITSRYVMG

SEQ ID NO: 880 - protein, 10 aa, Artificial Sequence
  Description of Artificial Sequence: Synthetic peptide
FSFDDDYVMG

SEQ ID NO: 881 - protein, 9 aa, Artificial Sequence
  Description of Artificial Sequence: Synthetic peptide
SISSINVMG

SEQ ID NO: 882 - protein, 9 aa, Artificial Sequence
  Description of Artificial Sequence: Synthetic peptide
LTFILYRMG

SEQ ID NO: 883 - protein, 9 aa, Artificial Sequence
  Description of Artificial Sequence: Synthetic peptide
GTFSVYHMG

SEQ ID NO: 884 - protein, 9 aa, Artificial Sequence
  Description of Artificial Sequence: Synthetic peptide
RAFSTYGMG

SEQ ID NO: 885 - protein, 9 aa, Artificial Sequence
  Description of Artificial Sequence: Synthetic peptide
RTFSDIAMG

SEQ ID NO: 886 - protein, 9 aa, Artificial Sequence
  Description of Artificial Sequence: Synthetic peptide
RTFSSARMG

SEQ ID NO: 887 - protein, 9 aa, Artificial Sequence
  Description of Artificial Sequence: Synthetic peptide
FAFSSYAMG

SEQ ID NO: 888 - protein, 9 aa, Artificial Sequence
  Description of Artificial Sequence: Synthetic peptide
ITFRRHDMG

SEQ ID NO: 889 - protein, 9 aa, Artificial Sequence
  Description of Artificial Sequence: Synthetic peptide
TAASFNPMG

SEQ ID NO: 890 - protein, 9 aa, Artificial Sequence
  Description of Artificial Sequence: Synthetic peptide
NINIINYMG

SEQ ID NO: 891 - protein, 9 aa, Artificial Sequence
  Description of Artificial Sequence: Synthetic peptide
FTFDDYAMG

SEQ ID NO: 892 - protein, 9 aa, Artificial Sequence
  Description of Artificial Sequence: Synthetic peptide
NIFTRNVMG

SEQ ID NO: 893 - protein, 9 aa, Artificial Sequence
  Description of Artificial Sequence: Synthetic peptide
RTFSSIAMG

SEQ ID NO: 894 - protein, 9 aa, Artificial Sequence
  Description of Artificial Sequence: Synthetic peptide
IPSTLRAMG

SEQ ID NO: 895 - protein, 9 aa, Artificial Sequence
  Description of Artificial Sequence: Synthetic peptide
FTLDDSAMG

SEQ ID NO: 896 - protein, 9 aa, Artificial Sequence
  Description of Artificial Sequence: Synthetic peptide
SISSFNAMG

SEQ ID NO: 897 - protein, 9 aa, Artificial Sequence
  Description of Artificial Sequence: Synthetic peptide
NIFSDNIIG

SEQ ID NO: 898 - protein, 9 aa, Artificial Sequence
  Description of Artificial Sequence: Synthetic peptide
SISSIGAMG

SEQ ID NO: 899 - protein, 9 aa, Artificial Sequence
  Description of Artificial Sequence: Synthetic peptide
FTFDDYGMG

SEQ ID NO: 900 - protein, 9 aa, Artificial Sequence
  Description of Artificial Sequence: Synthetic peptide
RTFSNYTMG

SEQ ID NO: 901 - protein, 6 aa, Artificial Sequence
  Description of Artificial Sequence: Synthetic peptide
STNYMG

SEQ ID NO: 902 - protein, 9 aa, Artificial Sequence
  Description of Artificial Sequence: Synthetic peptide
GTFSSVGMG

SEQ ID NO: 903 - protein, 9 aa, Artificial Sequence
  Description of Artificial Sequence: Synthetic peptide
RIFTNTAMG

SEQ ID NO: 904 - protein, 9 aa, Artificial Sequence
  Description of Artificial Sequence: Synthetic peptide
EEFSDHWMG

SEQ ID NO: 905 - protein, 9 aa, Artificial Sequence
  Description of Artificial Sequence: Synthetic peptide
RTFSSIAMG

SEQ ID NO: 906 - protein, 9 aa, Artificial Sequence
  Description of Artificial Sequence: Synthetic peptide
STSSLRTMG

SEQ ID NO: 907 - protein, 10 aa, Artificial Sequence
  Description of Artificial Sequence: Synthetic peptide
GGTFGSYAMG

SEQ ID NO: 908 - protein, 9 aa, Artificial Sequence
  Description of Artificial Sequence: Synthetic peptide
RTFSNAAMG

SEQ ID NO: 909 - protein, 9 aa, Artificial Sequence
  Description of Artificial Sequence: Synthetic peptide
IILSDNAMG

SEQ ID NO: 910 - protein, 9 aa, Artificial Sequence
  Description of Artificial Sequence: Synthetic peptide
RTFGDYIMG

SEQ ID NO: 911 - protein, 9 aa, Artificial Sequence
  Description of Artificial Sequence: Synthetic peptide
FNFNWYPMG

SEQ ID NO: 912 - protein, 9 aa, Artificial Sequence
  Description of Artificial Sequence: Synthetic peptide
SIRSVSVMG

SEQ ID NO: 913 - protein, 9 aa, Artificial Sequence
  Description of Artificial Sequence: Synthetic peptide
MTFRLYAMG

SEQ ID NO: 914 - protein, 9 aa, Artificial Sequence
  Description of Artificial Sequence: Synthetic peptide
RTFSDDAMG

SEQ ID NO: 915 - protein, 9 aa, Artificial Sequence
  Description of Artificial Sequence: Synthetic peptide
GTFSVYAMG

SEQ ID NO: 916 - protein, 9 aa, Artificial Sequence
  Description of Artificial Sequence: Synthetic peptide
FALGYYAMG

SEQ ID NO: 917 - protein, 9 aa, Artificial Sequence
  Description of Artificial Sequence: Synthetic peptide
FNLDDYAMG

SEQ ID NO: 918 - protein, 9 aa, Artificial Sequence
  Description of Artificial Sequence: Synthetic peptide
NTFSGGFMG

SEQ ID NO: 919 - protein, 9 aa, Artificial Sequence
  Description of Artificial Sequence: Synthetic peptide
SIRSINIMG

SEQ ID NO: 920 - protein, 13 aa, Artificial Sequence
  Description of Artificial Sequence: Synthetic peptide
ARISTSGGSTKYA

SEQ ID NO: 921 - protein, 13 aa, Artificial Sequence
  Description of Artificial Sequence: Synthetic peptide
ARITWNGGSTYYA

SEQ ID NO: 922 - protein, 13 aa, Artificial Sequence
  Description of Artificial Sequence: Synthetic peptide
AAVSWSGSGVYYA

SEQ ID NO: 923 - protein, 13 aa, Artificial Sequence
  Description of Artificial Sequence: Synthetic peptide
GAVSWSGGTTVYA

SEQ ID NO: 924 - protein, 13 aa, Artificial Sequence
  Description of Artificial Sequence: Synthetic peptide
AAINWSAGYTAYA

SEQ ID NO: 925 - protein, 15 aa, Artificial Sequence
  Description of Artificial Sequence: Synthetic peptide
AAISWSGGSTYTAYA

SEQ ID NO: 926 - protein, 13 aa, Artificial Sequence
  Description of Artificial Sequence: Synthetic peptide
ARILWTGASRNYA

SEQ ID NO: 927 - protein, 13 aa, Artificial Sequence
  Description of Artificial Sequence: Synthetic peptide
AAISWNGDFTAYA

SEQ ID NO: 928 - protein, 13 aa, Artificial Sequence
  Description of Artificial Sequence: Synthetic peptide
AGINWESGSTNYA

SEQ ID NO: 929 - protein, 12 aa, Artificial Sequence
  Description of Artificial Sequence: Synthetic peptide
AAIGSGGYTDYA

SEQ ID NO: 930 - protein, 12 aa, Artificial Sequence
  Description of Artificial Sequence: Synthetic peptide
SAVDSGGSTYYA

SEQ ID NO: 931 - protein, 13 aa, Artificial Sequence
  Description of Artificial Sequence: Synthetic peptide
AAVTWSGGSTYYA

SEQ ID NO: 932 - protein, 13 aa, Artificial Sequence
  Description of Artificial Sequence: Synthetic peptide
AAINWSAGYTPYA

SEQ ID NO: 933 - protein, 13 aa, Artificial Sequence
  Description of Artificial Sequence: Synthetic peptide
AAIHWSAGYTRYA

SEQ ID NO: 934 - protein, 13 aa, Artificial Sequence
  Description of Artificial Sequence: Synthetic peptide
AAINWSADYTPYA

SEQ ID NO: 935 - protein, 13 aa, Artificial Sequence
  Description of Artificial Sequence: Synthetic peptide
AAINWSAGYTAYA

SEQ ID NO: 936 - protein, 13 aa, Artificial Sequence
  Description of Artificial Sequence: Synthetic peptide
AAINWSGGSTDYA

SEQ ID NO: 937 - protein, 13 aa, Artificial Sequence
  Description of Artificial Sequence: Synthetic peptide
AGINWSGGNTYYA

SEQ ID NO: 938 - protein, 13 aa, Artificial Sequence
  Description of Artificial Sequence: Synthetic peptide
AAINWTGGYTSYA

SEQ ID NO: 939 - protein, 13 aa, Artificial Sequence
  Description of Artificial Sequence: Synthetic peptide
AAINWSGGNTYYA

SEQ ID NO: 940 - protein, 13 aa, Artificial Sequence
  Description of Artificial Sequence: Synthetic peptide
AAINWSGGYTYYA

SEQ ID NO: 941 - protein, 13 aa, Artificial Sequence
  Description of Artificial Sequence: Synthetic peptide
ATINWSGALTHYA

SEQ ID NO: 942 - protein, 13 aa, Artificial Sequence
  Description of Artificial Sequence: Synthetic peptide
AGVTWSGSSTFYA

SEQ ID NO: 943 - protein, 13 aa, Artificial Sequence
  Description of Artificial Sequence: Synthetic peptide
AAISWSGGNTHYA

SEQ ID NO: 944 - protein, 13 aa, Artificial Sequence
  Description of Artificial Sequence: Synthetic peptide
AAINWSAGYTAYA

SEQ ID NO: 945 - protein, 13 aa, Artificial Sequence
  Description of Artificial Sequence: Synthetic peptide
AAVSGSGDDTYYA

SEQ ID NO: 946 - protein, 13 aa, Artificial Sequence
  Description of Artificial Sequence: Synthetic peptide
AAINWSAGYTAYA

SEQ ID NO: 947 - protein, 13 aa, Artificial Sequence
  Description of Artificial Sequence: Synthetic peptide
AAINWSGGYTPYA

SEQ ID NO: 948 - protein, 13 aa, Artificial Sequence
  Description of Artificial Sequence: Synthetic peptide
AAINWSAGYTPYA

SEQ ID NO: 949 - protein, 13 aa, Artificial Sequence
  Description of Artificial Sequence: Synthetic peptide
AAISWSGGTTRYA

SEQ ID NO: 950 - protein, 13 aa, Artificial Sequence
  Description of Artificial Sequence: Synthetic peptide
AAINWSGDSTYYA

SEQ ID NO: 951 - protein, 13 aa, Artificial Sequence
  Description of Artificial Sequence: Synthetic peptide
AAINWSGGTTRYA

SEQ ID NO: 952 - protein, 13 aa, Artificial Sequence
  Description of Artificial Sequence: Synthetic peptide
AAIHWSGSSTRYA

SEQ ID NO: 953 - protein, 13 aa, Artificial Sequence
  Description of Artificial Sequence: Synthetic peptide
GTINWSGGSTYYA

SEQ ID NO: 954 - protein, 13 aa, Artificial Sequence
  Description of Artificial Sequence: Synthetic peptide
AAINWSGGYTPYA

SEQ ID NO: 955 - protein, 13 aa, Artificial Sequence
  Description of Artificial Sequence: Synthetic peptide
AAINWNGGNTHYA

SEQ ID NO: 956 - protein, 13 aa, Artificial Sequence
  Description of Artificial Sequence: Synthetic peptide
AAINWSGGTTRYA

SEQ ID NO: 957 - protein, 13 aa, Artificial Sequence
  Description of Artificial Sequence: Synthetic peptide
AAINWSAGYTPYA

SEQ ID NO: 958 - protein, 13 aa, Artificial Sequence
  Description of Artificial Sequence: Synthetic peptide
ASINWSGGSTYYA

SEQ ID NO: 959 - protein, 13 aa, Artificial Sequence
  Description of Artificial Sequence: Synthetic peptide
AGISWNGGSIYYA

SEQ ID NO: 960 - protein, 13 aa, Artificial Sequence
  Description of Artificial Sequence: Synthetic peptide
AAISWRGGTTYYA

SEQ ID NO: 961 - protein, 13 aa, Artificial Sequence
  Description of Artificial Sequence: Synthetic peptide
AAINWSGGYTPYA

SEQ ID NO: 962 - protein, 13 aa, Artificial Sequence
  Description of Artificial Sequence: Synthetic peptide
AAINWSGGSTRYA

SEQ ID NO: 963 - protein, 13 aa, Artificial Sequence
  Description of Artificial Sequence: Synthetic peptide
AVINWSGGSTDYA

SEQ ID NO: 964 - protein, 13 aa, Artificial Sequence
  Description of Artificial Sequence: Synthetic peptide
AAINWSGGTTPYA

SEQ ID NO: 965 - protein, 13 aa, Artificial Sequence
  Description of Artificial Sequence: Synthetic peptide
AAVSWSGGNTYYA

SEQ ID NO: 966 - protein, 13 aa, Artificial Sequence
  Description of Artificial Sequence: Synthetic peptide
AAINWTGGYTPYA

SEQ ID NO: 967 - protein, 13 aa, Artificial Sequence
  Description of Artificial Sequence: Synthetic peptide
ATINWTAGYTYYA

SEQ ID NO: 968 - protein, 13 aa, Artificial Sequence
  Description of Artificial Sequence: Synthetic peptide
AAINWSGGNTDYA

SEQ ID NO: 969 - protein, 13 aa, Artificial Sequence
  Description of Artificial Sequence: Synthetic peptide
AAINWSGGNTYYA

SEQ ID NO: 970 - protein, 13 aa, Artificial Sequence
  Description of Artificial Sequence: Synthetic peptide
AGINWSGNGVYYA

SEQ ID NO: 971 - protein, 13 aa, Artificial Sequence
  Description of Artificial Sequence: Synthetic peptide
APINWSGGSTYYA

SEQ ID NO: 972 - protein, 13 aa, Artificial Sequence
  Description of Artificial Sequence: Synthetic peptide
AVVNWSGRRTYYA

SEQ ID NO: 973 - protein, 13 aa, Artificial Sequence
  Description of Artificial Sequence: Synthetic peptide
AAITRSGSSTVYA

SEQ ID NO: 974 - protein, 13 aa, Artificial Sequence
  Description of Artificial Sequence: Synthetic peptide
AAINWTGGSTYYA

SEQ ID NO: 975 - protein, 13 aa, Artificial Sequence
  Description of Artificial Sequence: Synthetic peptide
AAINWSAGYTAYA

SEQ ID NO: 976 - protein, 13 aa, Artificial Sequence
  Description of Artificial Sequence: Synthetic peptide
GSINWSGGSTYYA

SEQ ID NO: 977 - protein, 13 aa, Artificial Sequence
  Description of Artificial Sequence: Synthetic peptide
AGMTWSGSSTFYA

SEQ ID NO: 978 - protein, 13 aa, Artificial Sequence
  Description of Artificial Sequence: Synthetic peptide
AAINWSGDYTDYA

SEQ ID NO: 979 - protein, 13 aa, Artificial Sequence
  Description of Artificial Sequence: Synthetic peptide
GGINWSGGYTYYA

SEQ ID NO: 980 - protein, 13 aa, Artificial Sequence
  Description of Artificial Sequence: Synthetic peptide
AAVNWSGGSTYYA

SEQ ID NO: 981 - protein, 13 aa, Artificial Sequence
  Description of Artificial Sequence: Synthetic peptide
AAINWSGGYTRYA

SEQ ID NO: 982 - protein, 13 aa, Artificial Sequence
  Description of Artificial Sequence: Synthetic peptide
AAINWSGGYTPYA

SEQ ID NO: 983 - protein, 13 aa, Artificial Sequence
  Description of Artificial Sequence: Synthetic peptide
AAINWSAGYTAYA

SEQ ID NO: 984 - protein, 13 aa, Artificial Sequence
  Description of Artificial Sequence: Synthetic peptide
AAINWSGGYTHYA

SEQ ID NO: 985 - protein, 13 aa, Artificial Sequence
  Description of Artificial Sequence: Synthetic peptide
AAITWSGGRTRYA

SEQ ID NO: 986 - protein, 13 aa, Artificial Sequence
  Description of Artificial Sequence: Synthetic peptide
AAINWSGGYTAYA

SEQ ID NO: 987 - protein, 13 aa, Artificial Sequence
  Description of Artificial Sequence: Synthetic peptide
AAIHWSGSSTRYA

SEQ ID NO: 988 - protein, 13 aa, Artificial Sequence
  Description of Artificial Sequence: Synthetic peptide
AAINWSGGTTYYA

SEQ ID NO: 989 - protein, 13 aa, Artificial Sequence
  Description of Artificial Sequence: Synthetic peptide
AAINWSGDNTHYA

SEQ ID NO: 990 - protein, 12 aa, Artificial Sequence
  Description of Artificial Sequence: Synthetic peptide
ASISSGGTTAYA

SEQ ID NO: 991 - protein, 13 aa, Artificial Sequence
  Description of Artificial Sequence: Synthetic peptide
GRINWSGGNTYYA

SEQ ID NO: 992 - protein, 13 aa, Artificial Sequence
  Description of Artificial Sequence: Synthetic peptide
GGISWSGGNTYYA

SEQ ID NO: 993 - protein, 13 aa, Artificial Sequence
  Description of Artificial Sequence: Synthetic peptide
AAINWSGGSTYYA

SEQ ID NO: 994 - protein, 13 aa, Artificial Sequence
  Description of Artificial Sequence: Synthetic peptide
AAINWSGGYTYYA

SEQ ID NO: 995 - protein, 13 aa, Artificial Sequence
  Description of Artificial Sequence: Synthetic peptide
AAINWSADYTAYA

SEQ ID NO: 996 - protein, 13 aa, Artificial Sequence
  Description of Artificial Sequence: Synthetic peptide
AAINWSGSSTYYA

SEQ ID NO: 997 - protein, 13 aa, Artificial Sequence
  Description of Artificial Sequence: Synthetic peptide
AAINWIAGYTADA

SEQ ID NO: 998 - protein, 13 aa, Artificial Sequence
  Description of Artificial Sequence: Synthetic peptide
AAINWSGGNTPYA

SEQ ID NO: 999 - protein, 13 aa, Artificial Sequence
  Description of Artificial Sequence: Synthetic peptide
AAINWSGDNTHYA

SEQ ID NO: 1000 - protein, 13 aa, Artificial Sequence
  Description of Artificial Sequence: Synthetic peptide
AAINWSAGYTAYA

SEQ ID NO: 1001 - protein, 13 aa, Artificial Sequence
  Description of Artificial Sequence: Synthetic peptide
AAINWNAGYTAYA

SEQ ID NO: 1002 - protein, 13 aa, Artificial Sequence
  Description of Artificial Sequence: Synthetic peptide
AAINWTGGYTYYA

SEQ ID NO: 1003 - protein, 13 aa, Artificial Sequence
  Description of Artificial Sequence: Synthetic peptide
AAINWSAGYTAYA

SEQ ID NO: 1004 - protein, 13 aa, Artificial Sequence
  Description of Artificial Sequence: Synthetic peptide
AAINWSGDNTHYA

SEQ ID NO: 1005 - protein, 13 aa, Artificial Sequence
  Description of Artificial Sequence: Synthetic peptide
AAINWSAGYTPYA

SEQ ID NO: 1006 - protein, 13 aa, Artificial Sequence
  Description of Artificial Sequence: Synthetic peptide
AAINWSAGYTAYA

SEQ ID NO: 1007 - protein, 13 aa, Artificial Sequence
  Description of Artificial Sequence: Synthetic peptide
AAINWSGGNTYYA

SEQ ID NO: 1008 - protein, 13 aa, Artificial Sequence
  Description of Artificial Sequence: Synthetic peptide
AAVSSLGPFTRYA

SEQ ID NO: 1009 - protein, 13 aa, Artificial Sequence
  Description of Artificial Sequence: Synthetic peptide
AAINWSGGSTYYA

SEQ ID NO: 1010 - protein, 13 aa, Artificial Sequence
  Description of Artificial Sequence: Synthetic peptide
ARILWTGASRSYA

SEQ ID NO: 1011 - protein, 13 aa, Artificial Sequence
  Description of Artificial Sequence: Synthetic peptide
AAINMSGDDSAYA

SEQ ID NO: 1012 - protein, 10 aa, Artificial Sequence
  Description of Artificial Sequence: Synthetic peptide
ARISGSTFYA

SEQ ID NO: 1013 - protein, 13 aa, Artificial Sequence
  Description of Artificial Sequence: Synthetic peptide
GRINWSGGNTYYA

SEQ ID NO: 1014 - protein, 13 aa, Artificial Sequence
  Description of Artificial Sequence: Synthetic peptide
AAITWSGGSTAYA

SEQ ID NO: 1015 - protein, 13 aa, Artificial Sequence
  Description of Artificial Sequence: Synthetic peptide
AAITDNGGSKYYA

SEQ ID NO: 1016 - protein, 13 aa, Artificial Sequence
  Description of Artificial Sequence: Synthetic peptide
AAINWSGASTYYA

SEQ ID NO: 1017 - protein, 13 aa, Artificial Sequence
  Description of Artificial Sequence: Synthetic peptide
AAISWSEDNTYYA

SEQ ID NO: 1018 - protein, 13 aa, Artificial Sequence
  Description of Artificial Sequence: Synthetic peptide
AAVSGSGDDTYYA

SEQ ID NO: 1019 - protein, 13 aa, Artificial Sequence
  Description of Artificial Sequence: Synthetic peptide
AAISASGRRTDYA

SEQ ID NO: 1020 - protein, 12 aa, Artificial Sequence
  Description of Artificial Sequence: Synthetic peptide
AAISTGGSTIYA

SEQ ID NO: 1021 - protein, 13 aa, Artificial Sequence
  Description of Artificial Sequence: Synthetic peptide
AAISNSGLSTYYA

SEQ ID NO: 1022 - protein, 13 aa, Artificial Sequence
  Description of Artificial Sequence: Synthetic peptide
ATMRWSTGSTYYA

SEQ ID NO: 1023 - protein, 12 aa, Artificial Sequence
  Description of Artificial Sequence: Synthetic peptide
AAINNFGTTKYA

SEQ ID NO: 1024 - protein, 13 aa, Artificial Sequence
  Description of Artificial Sequence: Synthetic peptide
AAISWSGGSTAYA

SEQ ID NO: 1025 - protein, 13 aa, Artificial Sequence
  Description of Artificial Sequence: Synthetic peptide
AGINWSGDTPYYA

SEQ ID NO: 1026 - protein, 13 aa, Artificial Sequence
  Description of Artificial Sequence: Synthetic peptide
ASINWGGGNTYYA

SEQ ID NO: 1027 - protein, 13 aa, Artificial Sequence
  Description of Artificial Sequence: Synthetic peptide
AAISWSGDNTHYA

SEQ ID NO: 1028 - protein, 12 aa, Artificial Sequence
  Description of Artificial Sequence: Synthetic peptide
ATINGDDYTYYA

SEQ ID NO: 1029 - protein, 13 aa, Artificial Sequence
  Description of Artificial Sequence: Synthetic peptide
AAIRWSSSSTVYA

SEQ ID NO: 1030 - protein, 12 aa, Artificial Sequence
  Description of Artificial Sequence: Synthetic peptide
AAITSGGSTNYA

SEQ ID NO: 1031 - protein, 13 aa, Artificial Sequence
  Description of Artificial Sequence: Synthetic peptide
AAIHWNGDSTAYA

SEQ ID NO: 1032 - protein, 13 aa, Artificial Sequence
  Description of Artificial Sequence: Synthetic peptide
AAISGSGGSTAYA

SEQ ID NO: 1033 - protein, 12 aa, Artificial Sequence
  Description of Artificial Sequence: Synthetic peptide
AAITSSGSTNYA

SEQ ID NO: 1034 - protein, 13 aa, Artificial Sequence
  Description of Artificial Sequence: Synthetic peptide
ASINWGGGNTIYA

SEQ ID NO: 1035 - protein, 13 aa, Artificial Sequence
  Description of Artificial Sequence: Synthetic peptide
AAVSSLGPFTRYA

SEQ ID NO: 1036 - protein, 12 aa, Artificial Sequence
  Description of Artificial Sequence: Synthetic peptide
AAITNGGSTYYA

SEQ ID NO: 1037 - protein, 12 aa, Artificial Sequence
  Description of Artificial Sequence: Synthetic peptide
AAIDWDGSTAYA

SEQ ID NO: 1038 - protein, 12 aa, Artificial Sequence
  Description of Artificial Sequence: Synthetic peptide
AYYTSGGSIDYA

SEQ ID NO: 1039 - protein, 13 aa, Artificial Sequence
  Description of Artificial Sequence: Synthetic peptide
AAISSSGSSTVYA

SEQ ID NO: 1040 - protein, 13 aa, Artificial Sequence
  Description of Artificial Sequence: Synthetic peptide
ATITWSGDSTYYA

SEQ ID NO: 1041 - protein, 13 aa, Artificial Sequence
  Description of Artificial Sequence: Synthetic peptide
SAISWSTGSTYYA

SEQ ID NO: 1042 - protein, 13 aa, Artificial Sequence
  Description of Artificial Sequence: Synthetic peptide
AAISMSGDDTIYA

SEQ ID NO: 1043 - protein, 13 aa, Artificial Sequence
  Description of Artificial Sequence: Synthetic peptide
AVINWSGARTYYA

SEQ ID NO: 1044 - protein, 13 aa, Artificial Sequence
  Description of Artificial Sequence: Synthetic peptide
AAINWSGGSTAYA

SEQ ID NO: 1045 - protein, 13 aa, Artificial Sequence
  Description of Artificial Sequence: Synthetic peptide
GAIHWSGGRTYYA

SEQ ID NO: 1046 - protein, 13 aa, Artificial Sequence
  Description of Artificial Sequence: Synthetic peptide
AAINWSGARTAYA

SEQ ID NO: 1047 - protein, 13 aa, Artificial Sequence
  Description of Artificial Sequence: Synthetic peptide
AAISSRDGSTIYA

SEQ ID NO: 1048 - protein, 17 aa, Artificial Sequence
  Description of Artificial Sequence: Synthetic peptide
AAISIASGASGGTTNYA

SEQ ID NO: 1049 - protein, 13 aa, Artificial Sequence
  Description of Artificial Sequence: Synthetic peptide
ARITWNGGSTFYA

SEQ ID NO: 1050 - protein, 13 aa, Artificial Sequence
  Description of Artificial Sequence: Synthetic peptide
AAISWLGESTYYA

SEQ ID NO: 1051 - protein, 13 aa, Artificial Sequence
  Description of Artificial Sequence: Synthetic peptide
AAINWNGGYTAYA

SEQ ID NO: 1052 - protein, 15 aa, Artificial Sequence
  Description of Artificial Sequence: Synthetic peptide
AAISWTGVSTYTAYA

SEQ ID NO: 1053 - protein, 13 aa, Artificial Sequence
  Description of Artificial Sequence: Synthetic peptide
AAISWSGVGTAYA

SEQ ID NO: 1054 - protein, 13 aa, Artificial Sequence
  Description of Artificial Sequence: Synthetic peptide
GAINWLSESTYYA

SEQ ID NO: 1055 - protein, 13 aa, Artificial Sequence
  Description of Artificial Sequence: Synthetic peptide
AAINWSGGSTYYA

SEQ ID NO: 1056 - protein, 13 aa, Artificial Sequence
  Description of Artificial Sequence: Synthetic peptide
AAISMSGDDAAYA

SEQ ID NO: 1057 - protein, 13 aa, Artificial Sequence
  Description of Artificial Sequence: Synthetic peptide
AAISSRDGSTAYA

SEQ ID NO: 1058 - protein, 13 aa, Artificial Sequence
  Description of Artificial Sequence: Synthetic peptide
AAISWDGGATAYA

SEQ ID NO: 1059 - protein, 12 aa, Artificial Sequence
  Description of Artificial Sequence: Synthetic peptide
ASIRSGARTYYA

SEQ ID NO: 1060 - protein, 13 aa, Artificial Sequence
  Description of Artificial Sequence: Synthetic peptide
AAISWSGGSTVYA

SEQ ID NO: 1061 - skipped

SEQ ID NO: 1062 - protein, 13 aa, Artificial Sequence
  Description of Artificial Sequence: Synthetic peptide
CARTTVTTPPLIW

SEQ ID NO: 1063 - protein, 11 aa, Artificial Sequence
  Description of Artificial Sequence: Synthetic peptide
CATTENPNPRW

SEQ ID NO: 1064 - protein, 9 aa, Artificial Sequence
  Description of Artificial Sequence: Synthetic peptide
CATDPPLFW

SEQ ID NO: 1065 - protein, 11 aa, Artificial Sequence
  Description of Artificial Sequence: Synthetic peptide
CATTEDPYPRW

SEQ ID NO: 1066 - protein, 15 aa, Artificial Sequence
  Description of Artificial Sequence: Synthetic peptide
CARASPNTGWHFDHW

SEQ ID NO: 1067 - protein, 11 aa, Artificial Sequence
  Description of Artificial Sequence: Synthetic peptide
CAAYQAGWGDW

SEQ ID NO: 1068 - protein, 11 aa, Artificial Sequence
  Description of Artificial Sequence: Synthetic peptide
CATTENPNPRW

SEQ ID NO: 1069 - protein, 15 aa, Artificial Sequence
  Description of Artificial Sequence: Synthetic peptide
CAKRANPTGAYFDYW

SEQ ID NO: 1070 - protein, 20 aa, Artificial Sequence
  Description of Artificial Sequence: Synthetic peptide
CAADRGVYGGRWYRTSQYTW

SEQ ID NO: 1071 - protein, 17 aa, Artificial Sequence
  Description of Artificial Sequence: Synthetic peptide
CAVKPGWVARDPSQYNW

SEQ ID NO: 1072 - protein, 13 aa, Artificial Sequence
  Description of Artificial Sequence: Synthetic peptide
CAASPSLRSAWQW

SEQ ID NO: 1073 - protein, 18 aa, Artificial Sequence
  Description of Artificial Sequence: Synthetic peptide
CAADRRGLASTRAADYDW

SEQ ID NO: 1074 - protein, 15 aa, Artificial Sequence
  Description of Artificial Sequence: Synthetic peptide
CATAPPLFCWHFDLW

SEQ ID NO: 1075 - protein, 15 aa, Artificial Sequence
  Description of Artificial Sequence: Synthetic peptide
CATDPPLFWGHVDLW

SEQ ID NO: 1076 - protein, 15 aa, Artificial Sequence
  Description of Artificial Sequence: Synthetic peptide
CATAPPNTGWHFDHW

SEQ ID NO: 1077 - protein, 15 aa, Artificial Sequence
  Description of Artificial Sequence: Synthetic peptide
CATATPNTGWHFDHW

SEQ ID NO: 1078 - protein, 9 aa, Artificial Sequence
  Description of Artificial Sequence: Synthetic peptide
CATDPPLFW

SEQ ID NO: 1079 - protein, 9 aa, Artificial Sequence
  Description of Artificial Sequence: Synthetic peptide
CATDPPLFW

SEQ ID NO: 1080 - protein, 9 aa, Artificial Sequence
  Description of Artificial Sequence: Synthetic peptide
CATDPPLFW

SEQ ID NO: 1081 - protein, 9 aa, Artificial Sequence
  Description of Artificial Sequence: Synthetic peptide
CATDPPLFW

SEQ ID NO: 1082 - protein, 9 aa, Artificial Sequence
  Description of Artificial Sequence: Synthetic peptide
CATDPPLFW

SEQ ID NO: 1083 - protein, 23 aa, Artificial Sequence
  Description of Artificial Sequence: Synthetic peptide
CATLPFYDFWSGYYTGYYYMDVW

SEQ ID NO: 1084 - protein, 9 aa, Artificial Sequence
  Description of Artificial Sequence: Synthetic peptide
CATDPPLFW

SEQ ID NO: 1085 - protein, 9 aa, Artificial Sequence
  Description of Artificial Sequence: Synthetic peptide
CATDPPLFW

SEQ ID NO: 1086 - protein, 15 aa, Artificial Sequence
  Description of Artificial Sequence: Synthetic peptide
CATASPNTGWHFDHW

SEQ ID NO: 1087 - protein, 18 aa, Artificial Sequence
  Description of Artificial Sequence: Synthetic peptide
CAADRRGLASTRAADYDW

SEQ ID NO: 1088 - protein, 15 aa, Artificial Sequence
  Description of Artificial Sequence: Synthetic peptide
CATEPPLSCWHFDLW

SEQ ID NO: 1089 - protein, 15 aa, Artificial Sequence
  Description of Artificial Sequence: Synthetic peptide
CATAPPNTGWHFDHW

SEQ ID NO: 1090 - protein, 15 aa, Artificial Sequence
  Description of Artificial Sequence: Synthetic peptide
CATDPPLFCCHFDLW

SEQ ID NO: 1091 - protein, 9 aa, Artificial Sequence
  Description of Artificial Sequence: Synthetic peptide
CATDPPLFW

SEQ ID NO: 1092 - protein, 9 aa, Artificial Sequence
  Description of Artificial Sequence: Synthetic peptide
CATDPPLFW

SEQ ID NO: 1093 - protein, 9 aa, Artificial Sequence
  Description of Artificial Sequence: Synthetic peptide
CATDPPLFW

SEQ ID NO: 1094 - protein, 9 aa, Artificial Sequence
  Description of Artificial Sequence: Synthetic peptide
CATDPPLFW

SEQ ID NO: 1095 - protein, 9 aa, Artificial Sequence
  Description of Artificial Sequence: Synthetic peptide
CATDPPLFW

SEQ ID NO: 1096 - protein, 9 aa, Artificial Sequence
  Description of Artificial Sequence: Synthetic peptide
CATDPPLFW

SEQ ID NO: 1097 - protein, 9 aa, Artificial Sequence
  Description of Artificial Sequence: Synthetic peptide
CATDPPLFW

SEQ ID NO: 1098 - protein, 9 aa, Artificial Sequence
  Description of Artificial Sequence: Synthetic peptide
CATDPPLFW

SEQ ID NO: 1099 - protein, 15 aa, Artificial Sequence
  Description of Artificial Sequence: Synthetic peptide
CATDPPLFWGHVDLW

SEQ ID NO: 1100 - protein, 9 aa, Artificial Sequence
  Description of Artificial Sequence: Synthetic peptide
CATDPPLFW

SEQ ID NO: 1101 - protein, 9 aa, Artificial Sequence
  Description of Artificial Sequence: Synthetic peptide
CATDPPLFW

SEQ ID NO: 1102 - protein, 18 aa, Artificial Sequence
  Description of Artificial Sequence: Synthetic peptide
CAADRRGLASTRAGDYDW

SEQ ID NO: 1103 - protein, 15 aa, Artificial Sequence
  Description of Artificial Sequence: Synthetic peptide
CATDPPLFWGHVDLW

SEQ ID NO: 1104 - protein, 9 aa, Artificial Sequence
  Description of Artificial Sequence: Synthetic peptide
CATDPPLFW

SEQ ID NO: 1105 - protein, 23 aa, Artificial Sequence
  Description of Artificial Sequence: Synthetic peptide
CARGGGWVPSSTSESLNWYFDRW

SEQ ID NO: 1106 - protein, 15 aa, Artificial Sequence
  Description of Artificial Sequence: Synthetic peptide
CATDPPLFCCHVDLW

SEQ ID NO: 1107 - protein, 9 aa, Artificial Sequence
  Description of Artificial Sequence: Synthetic peptide
CATDPPLFW

SEQ ID NO: 1108 - protein, 9 aa, Artificial Sequence
  Description of Artificial Sequence: Synthetic peptide
CATDPPLFW

SEQ ID NO: 1109 - protein, 15 aa, Artificial Sequence
  Description of Artificial Sequence: Synthetic peptide
CATDPPLFCWHFDHW

SEQ ID NO: 1110 - protein, 9 aa, Artificial Sequence
  Description of Artificial Sequence: Synthetic peptide
CATDPPLFW

SEQ ID NO: 1111 - protein, 9 aa, Artificial Sequence
  Description of Artificial Sequence: Synthetic peptide
CATDPPLFW

SEQ ID NO: 1112 - protein, 9 aa, Artificial Sequence
  Description of Artificial Sequence: Synthetic peptide
CATDPPLFW

SEQ ID NO: 1113 - protein, 9 aa, Artificial Sequence
  Description of Artificial Sequence: Synthetic peptide
CATDPPLFW

SEQ ID NO: 1114 - protein, 13 aa, Artificial Sequence
  Description of Artificial Sequence: Synthetic peptide
CAVPWMDYNRRDW

SEQ ID NO: 1115 - protein, 11 aa, Artificial Sequence
  Description of Artificial Sequence: Synthetic peptide
CATTMNPNPRW

SEQ ID NO: 1116 - protein, 9 aa, Artificial Sequence
  Description of Artificial Sequence: Synthetic peptide
CATDPPLFW

SEQ ID NO: 1117 - protein, 15 aa, Artificial Sequence
  Description of Artificial Sequence: Synthetic peptide
CATARPNTGWHFDHW

SEQ ID NO: 1118 - protein, 9 aa, Artificial Sequence
  Description of Artificial Sequence: Synthetic peptide
CATDPPLFW

SEQ ID NO: 1119 - protein, 9 aa, Artificial Sequence
  Description of Artificial Sequence: Synthetic peptide
CATDPPLFW

SEQ ID NO: 1120 - protein, 9 aa, Artificial Sequence
  Description of Artificial Sequence: Synthetic peptide
CATDPPLFW

SEQ ID NO: 1121 - protein, 9 aa, Artificial Sequence
  Description of Artificial Sequence: Synthetic peptide
CATDPPLFW

SEQ ID NO: 1122 - protein, 9 aa, Artificial Sequence
  Description of Artificial Sequence: Synthetic peptide
CATDPPLFW

SEQ ID NO: 1123 - protein, 9 aa, Artificial Sequence
  Description of Artificial Sequence: Synthetic peptide
CATDPPLFW

SEQ ID NO: 1124 - protein, 9 aa, Artificial Sequence
  Description of Artificial Sequence: Synthetic peptide
CATDPPLFW

SEQ ID NO: 1125 - protein, 15 aa, Artificial Sequence
  Description of Artificial Sequence: Synthetic peptide
CARASPNTGWHFDRW

SEQ ID NO: 1126 - protein, 9 aa, Artificial Sequence
  Description of Artificial Sequence: Synthetic peptide
CATDPPLFW

SEQ ID NO: 1127 - protein, 9 aa, Artificial Sequence
  Description of Artificial Sequence: Synthetic peptide
CATDRPLFW

SEQ ID NO: 1128 - protein, 15 aa, Artificial Sequence
  Description of Artificial Sequence: Synthetic peptide
CATASPNTGWHFDHW

SEQ ID NO: 1129 - protein, 9 aa, Artificial Sequence
  Description of Artificial Sequence: Synthetic peptide
CATDPPLFW

SEQ ID NO: 1130 - protein, 9 aa, Artificial Sequence
  Description of Artificial Sequence: Synthetic peptide
CATDPPLFW

SEQ ID NO: 1131 - protein, 9 aa, Artificial Sequence
  Description of Artificial Sequence: Synthetic peptide
CATDPPLFW

SEQ ID NO: 1132 - protein, 14 aa, Artificial Sequence
  Description of Artificial Sequence: Synthetic peptide
CAHRGGWLRPWGYW

SEQ ID NO: 1133 - protein, 9 aa, Artificial Sequence
  Description of Artificial Sequence: Synthetic peptide
CATDPPLFW

SEQ ID NO: 1134 - protein, 9 aa, Artificial Sequence
  Description of Artificial Sequence: Synthetic peptide
CATDPPLFW

SEQ ID NO: 1135 - protein, 9 aa, Artificial Sequence
  Description of Artificial Sequence: Synthetic peptide
CATDPPLFW

SEQ ID NO: 1136 - protein, 9 aa, Artificial Sequence
  Description of Artificial Sequence: Synthetic peptide
CATDPPLFW

SEQ ID NO: 1137 - protein, 15 aa, Artificial Sequence
  Description of Artificial Sequence: Synthetic peptide
CATDPPLFCWHFDHW

SEQ ID NO: 1138 - protein, 9 aa, Artificial Sequence
  Description of Artificial Sequence: Synthetic peptide
CATDPPLFW

SEQ ID NO: 1139 - protein, 15 aa, Artificial Sequence
  Description of Artificial Sequence: Synthetic peptide
CAEPSPNTGWHFDHW

SEQ ID NO: 1140 - protein, 9 aa, Artificial Sequence
  Description of Artificial Sequence: Synthetic peptide
CATDPPLFW

SEQ ID NO: 1141 - protein, 9 aa, Artificial Sequence
  Description of Artificial Sequence: Synthetic peptide
CATDPPLFW

SEQ ID NO: 1142 - protein, 15 aa, Artificial Sequence
  Description of Artificial Sequence: Synthetic peptide
CATAPPLFCWHFDHW

SEQ ID NO: 1143 - protein, 15 aa, Artificial Sequence
  Description of Artificial Sequence: Synthetic peptide
CAKASPNTGWHFDHW

SEQ ID NO: 1144 - protein, 9 aa, Artificial Sequence
  Description of Artificial Sequence: Synthetic peptide
CATDPPLFW

SEQ ID NO: 1145 - protein, 15 aa, Artificial Sequence
  Description of Artificial Sequence: Synthetic peptide
CARATPNTGWHFDHW

SEQ ID NO: 1146 - protein, 9 aa, Artificial Sequence
  Description of Artificial Sequence: Synthetic peptide
CATDPPLFW

SEQ ID NO: 1147 - protein, 15 aa, Artificial Sequence
  Description of Artificial Sequence: Synthetic peptide
CATDPPLFCCHFDHW

SEQ ID NO: 1148 - protein, 15 aa, Artificial Sequence
  Description of Artificial Sequence: Synthetic peptide
CATAPPNTGWHFDHW

SEQ ID NO: 1149 - protein, 18 aa, Artificial Sequence
  Description of Artificial Sequence: Synthetic peptide
CAADRRGLASTRAADYDW

SEQ ID NO: 1150 - protein, 17 aa, Artificial Sequence
  Description of Artificial Sequence: Synthetic peptide
CAAKPGWVARDPSQYNW

SEQ ID NO: 1151 - protein, 18 aa, Artificial Sequence
  Description of Artificial Sequence: Synthetic peptide
CAADRRGLASTRAADYDW

SEQ ID NO: 1152 - protein, 11 aa, Artificial Sequence
  Description of Artificial Sequence: Synthetic peptide
CATTENPNPRW

SEQ ID NO: 1153 - protein, 15 aa, Artificial Sequence
  Description of Artificial Sequence: Synthetic peptide
CAILVGPGQVEFDHW

SEQ ID NO: 1154 - protein, 22 aa, Artificial Sequence
  Description of Artificial Sequence: Synthetic peptide
CAALPFVCPSGSYSDYGDEYDW

SEQ ID NO: 1155 - protein, 9 aa, Artificial Sequence
  Description of Artificial Sequence: Synthetic peptide
CPTDPPLFW

SEQ ID NO: 1156 - protein, 14 aa, Artificial Sequence
  Description of Artificial Sequence: Synthetic peptide
CASLLAGDRYFDYW

SEQ ID NO: 1157 - protein, 18 aa, Artificial Sequence
  Description of Artificial Sequence: Synthetic peptide
CAADRRGLASTRAADYDW

SEQ ID NO: 1158 - protein, 17 aa, Artificial Sequence
  Description of Artificial Sequence: Synthetic peptide
CARDWRDRTWGNSLDYW

SEQ ID NO: 1159 - protein, 18 aa, Artificial Sequence
  Description of Artificial Sequence: Synthetic peptide
CAADRRGLASTRAADYDW

SEQ ID NO: 1160 - protein, 18 aa, Artificial Sequence
  Description of Artificial Sequence: Synthetic peptide
CAADRRGLASTRAADYDW

SEQ ID NO: 1161 - protein, 21 aa, Artificial Sequence
  Description of Artificial Sequence: Synthetic peptide
CARRVYYYDSSGPPGVTFDIW

SEQ ID NO: 1162 - protein, 14 aa, Artificial Sequence
  Description of Artificial Sequence: Synthetic peptide
CARQDSSSPYFDYW

SEQ ID NO: 1163 - protein, 18 aa, Artificial Sequence
  Description of Artificial Sequence: Synthetic peptide
CAADRRGLASTRAADYDW

SEQ ID NO: 1164 - protein, 21 aa, Artificial Sequence
  Description of Artificial Sequence: Synthetic peptide
CAQRVRGFFGPLRTTPSWYEW

SEQ ID NO: 1165 - protein, 23 aa, Artificial Sequence
  Description of Artificial Sequence: Synthetic peptide
CARTHYDFWSGYTSRTPNYFDYW

SEQ ID NO: 1166 - protein, 15 aa, Artificial Sequence
  Description of Artificial Sequence: Synthetic peptide
CAAVNTWTSPSFDSW

SEQ ID NO: 1167 - protein, 15 aa, Artificial Sequence
  Description of Artificial Sequence: Synthetic peptide
CAREVGPPPGYFDLW

SEQ ID NO: 1168 - protein, 18 aa, Artificial Sequence
  Description of Artificial Sequence: Synthetic peptide
CAAKGIWDYLGRRDFGDW

SEQ ID NO: 1169 - protein, 11 aa, Artificial Sequence
  Description of Artificial Sequence: Synthetic peptide
CATTENPNPRW

SEQ ID NO: 1170 - protein, 11 aa, Artificial Sequence
  Description of Artificial Sequence: Synthetic peptide
CVATPGGYGLW

SEQ ID NO: 1171 - protein, 20 aa, Artificial Sequence
  Description of Artificial Sequence: Synthetic peptide
CAADRGVYGGRWYRTSQYTW

SEQ ID NO: 1172 - protein, 15 aa, Artificial Sequence
  Description of Artificial Sequence: Synthetic peptide
CAAIAYEEGVYRWDW

SEQ ID NO: 1173 - protein, 14 aa, Artificial Sequence
  Description of Artificial Sequence: Synthetic peptide
CASGPPYSNYFAYW

SEQ ID NO: 1174 - protein, 15 aa, Artificial Sequence
  Description of Artificial Sequence: Synthetic peptide
CAKIMGSGRPYFDHW

SEQ ID NO: 1175 - protein, 15 aa, Artificial Sequence
  Description of Artificial Sequence: Synthetic peptide
CARPSSDLQGGVDYW

SEQ ID NO: 1176 - protein, 18 aa, Artificial Sequence
  Description of Artificial Sequence: Synthetic peptide
CAAKGIWDYLGRRDFGDW

SEQ ID NO: 1177 - protein, 17 aa, Artificial Sequence
  Description of Artificial Sequence: Synthetic peptide
CAAKPGWVARDPSEYNW

SEQ ID NO: 1178 - protein, 14 aa, Artificial Sequence
  Description of Artificial Sequence: Synthetic peptide
CARFARGSPYFDFW

SEQ ID NO: 1179 - protein, 16 aa, Artificial Sequence
  Description of Artificial Sequence: Synthetic peptide
CARGGGYYGSGSFEYW

SEQ ID NO: 1180 - protein, 18 aa, Artificial Sequence
  Description of Artificial Sequence: Synthetic peptide
CARGTAVGRPPPGGMDVW

SEQ ID NO: 1181 - protein, 14 aa, Artificial Sequence
  Description of Artificial Sequence: Synthetic peptide
CARVPPGQAYFDSW

SEQ ID NO: 1182 - protein, 18 aa, Artificial Sequence
  Description of Artificial Sequence: Synthetic peptide
CAKGGSWYYDSSGYYGRW

SEQ ID NO: 1183 - protein, 13 aa, Artificial Sequence
  Description of Artificial Sequence: Synthetic peptide
CAADRYGPPWYDW

SEQ ID NO: 1184 - protein, 14 aa, Artificial Sequence
  Description of Artificial Sequence: Synthetic peptide
CARIGLRGRYFDLW

SEQ ID NO: 1185 - protein, 13 aa, Artificial Sequence
  Description of Artificial Sequence: Synthetic peptide
CAVPWMDYNRRDW

SEQ ID NO: 1186 - protein, 13 aa, Artificial Sequence
  Description of Artificial Sequence: Synthetic peptide
CARTSGSYSFDYW

SEQ ID NO: 1187 - protein, 18 aa, Artificial Sequence
  Description of Artificial Sequence: Synthetic peptide
CAADRRGLASTRAADYDW

SEQ ID NO: 1188 - protein, 18 aa, Artificial Sequence
  Description of Artificial Sequence: Synthetic peptide
CAAKGIWDYLGRRDFGDW

SEQ ID NO: 1189 - protein, 14 aa, Artificial Sequence
  Description of Artificial Sequence: Synthetic peptide
CARDDSSSPYFDYW

SEQ ID NO: 1190 - protein, 11 aa, Artificial Sequence
  Description of Artificial Sequence: Synthetic peptide
CATTMNPNPRW

SEQ ID NO: 1191 - protein, 11 aa, Artificial Sequence
  Description of Artificial Sequence: Synthetic peptide
CATTENPNPRW

SEQ ID NO: 1192 - protein, 18 aa, Artificial Sequence
  Description of Artificial Sequence: Synthetic peptide
CAADRRGLASTRAADYDW

SEQ ID NO: 1193 - protein, 15 aa, Artificial Sequence
  Description of Artificial Sequence: Synthetic peptide
CATTSPNTGWHYYRW

SEQ ID NO: 1194 - protein, 21 aa, Artificial Sequence
  Description of Artificial Sequence: Synthetic peptide
CARWGPGPAGGSPGLVGFDYW

SEQ ID NO: 1195 - protein, 11 aa, Artificial Sequence
  Description of Artificial Sequence: Synthetic peptide
CAAYQRGWGDW

SEQ ID NO: 1196 - protein, 17 aa, Artificial Sequence
  Description of Artificial Sequence: Synthetic peptide
CAAKPGWVARDPSEYNW

SEQ ID NO: 1197 - protein, 9 aa, Artificial Sequence
  Description of Artificial Sequence: Synthetic peptide
CATDPPLFW

SEQ ID NO: 1198 - protein, 20 aa, Artificial Sequence
  Description of Artificial Sequence: Synthetic peptide
CAKISKDDGGKPRGAFFDSW

SEQ ID NO: 1199 - protein, 15 aa, Artificial Sequence
  Description of Artificial Sequence: Synthetic peptide
CARLATGPQAYFHHW

SEQ ID NO: 1200 - protein, 14 aa, Artificial Sequence
  Description of Artificial Sequence: Synthetic peptide
CARVGRGTTAFDSW

SEQ ID NO: 1201 - protein, 21 aa, Artificial Sequence
  Description of Artificial Sequence: Synthetic peptide
CAQRVRGFFGPLRTTPSWYEW

SEQ ID NO: 1202 - protein, 14 aa, Artificial Sequence
  Description of Artificial Sequence: Synthetic peptide
CASLLAGDRYFDYW

SEQ ID NO: 1203 - protein, 116 aa, Artificial Sequence
  Description of Artificial Sequence: Synthetic polypeptide
EVQLVESGGGLVQPGGSLRLSCAASGPGTAIMGWFRQAPGKEREFVARISTSGGSTKYADSVKGRFTISADNSKNTAYLQMNSLKPEDTAVYYCARTTVTTPPLIWGQGTLVTVSS

SEQ ID NO: 1204 - protein, 116 aa, Artificial Sequence
  Description of Artificial Sequence: Synthetic polypeptide
EVQLVESGGGLVQPGGSLRLSCAASGRSFSNSVMGWFRQAPGKEREFVARITWNGGSTYYADSVKGRFTISADNSKNTAYLQMNSLKPEDTAVYYCATTENPNPRWGQGTLVTVSS

SEQ ID NO: 1205 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAVSWSGSGVYYADSVKGRFTITADNSKNTAYLQMNSLKPENTAVYYCATDPPLFWGQGTLVTVSS

SEQ ID NO: 1206 - protein, 116 aa, Artificial Sequence
  Description of Artificial Sequence: Synthetic polypeptide
EVQLVESGGGLVQPGGSLRLSCAASGRTFSDARMGWFRQAPGKEREFVGAVSWSGGTTVYADSVKGRFTISADNSKNTAYLQMNSLKPEDTAVYYCATTEDPYPRWGQGTLVTVSS

SEQ ID NO: 1207 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDHWGQGTLVTVSS

SEQ ID NO: 1208 - protein, 118 aa, Artificial Sequence
  Description of Artificial Sequence: Synthetic polypeptide
EVQLVESGGGLVQPGGSLRLSCAASGSGLSINAMGWFRQAPGKERESVAAISWSGGSTYTAYADSVKGRFTISADNSKNTAYLQMNSLKPEDTAVYYCAAYQAGWGDWGQGTLVTVSS

SEQ ID NO: 1209 - protein, 116 aa, Artificial Sequence
  Description of Artificial Sequence: Synthetic polypeptide
EVQLVESGGGLVQPGGSLRLSCAASGRTFSNAAMGWFRQAPGKEREFVARILWTGASRNYADSVKGRFTISADNSKNTAYLQMNSLKPEDTAVYYCATTENPNPRWGQGTLVTVSS

SEQ ID NO: 1210 - protein, 120 aa, Artificial Sequence
  Description of Artificial Sequence: Synthetic polypeptide
EVQLVESGGGLVQPGGSLRLSCAASGFSLDYYGMGWFRQAPGKERESVAAISWNGDFTAYADSVKGRFTISADNSKNTAYLQMNSLKPEDTAVYYCAKRANPTGAYFDYWGQGTLVTVSS

SEQ ID NO: 1211 - protein, 125 aa, Artificial Sequence
  Description of Artificial Sequence: Synthetic polypeptide
EVQLVESGGGLVQPGGSLRLSCAASGFTFSRHDMGWFRQAPGKEREFVAGINWESGSTNYADSVKGRFTISADNSKNTAYLQMNSLKPEDTAVYYCAADRGVYGGRWYRTSQYTWGQGTLVTVSS

SEQ ID NO: 1212 - protein, 121 aa, Artificial Sequence
  Description of Artificial Sequence: Synthetic polypeptide
EVQLVESGGGLVQPGGSLRLSCAASGLTFRNYAMGWFRQAPGKEREFVAAIGSGGYTDYADSVKGRFTISADNSKNTAYLQMNSLKPEDTAVYYCAVKPGWVARDPSQYNWGQGTLVTVSS

SEQ ID NO: 1213 - protein, 117 aa, Artificial Sequence
  Description of Artificial Sequence: Synthetic polypeptide
EVQLVESGGGLVQPGGSLRLSCAASGGTFSRYAMGWFRQAPGKEREWVSAVDSGGSTYYADSVKGRFTISADNSKNTAYLQMNSLKPEDTAVYYCAASPSLRSAWQWGQGTLVTVSS

SEQ ID NO: 1214 - protein, 123 aa, Artificial Sequence
  Description of Artificial Sequence: Synthetic polypeptide
EVQLVESGGGLVQPGGSLRLSCAASGFTLDYYDMGWFRQAPGKEREFVAAVTWSGGSTYYADSVKGRFTISADNSKNTAYLQMNSLKPEDTAVYYCAADRRGLASTRAADYDWGQGTLVTVSS

SEQ ID NO: 1215 - protein, 120 aa, Artificial Sequence
  Description of Artificial Sequence: Synthetic polypeptide
EVQLVESGGGLVQPGGSLRLSCAASGRTFGDYIMGWFRQAPGKEREFVAAINWSAGYTPYADSVKGRFTISADNSKNTAYLQMNSLKPEDTAVYYCATAPPLFCWHFDLWGQGTLVTVSS

SEQ ID NO: 1216 - protein, 120 aa, Artificial Sequence
  Description of Artificial Sequence: Synthetic polypeptide
EVQLVESGGGLVQPGGSLRLSCAASGRTFGDDIMGWFRQAPGKEREFVAAIHWSAGYTRYADSVKGRFTISADNSKNTAYLQMNSLKPEDTAVYYCATDPPLFWGHVDLWGQGTLVTVSS

SEQ ID NO: 1217 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSADYTPYADSVKGRFTISADNSKNTAYLQMNSLKPEDTAVYYCATAPPNTGWHFDHWGQGTLVTVSS

SEQ ID NO: 1218 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATATPNTGWHFDHWGQGTLVTVSS

SEQ ID NO: 1219 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGGSTDYADSVKGRFTISADNSKNTAYLQMNSLKPEDTAVYYCATDPPLFWGQGTLVTVSS

SEQ ID NO: 1220 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAGINWSGGNTYYADSVKGRFTISADNSKNTAYLQMNSLKPEDTAVYYCATDPPLFWGQGTLVTVSS

SEQ ID NO: 1221 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWTGGYTSYADSVKGRFTISADNSKNTAYLQMNSLKPEDTAVYYCATDPPLFWGQGTLVTVSS

SEQ ID NO: 1222 - protein, 114 aa, Artificial Sequence
  Description of Artificial Sequence: Synthetic polypeptide
EVQLVESGGGLVQPGGSLRLSCAASGRTFGDDTMGWFRQAPGKERECVAAINWSGGNTYYADSVKGRFTISADNSKNTAYLQMNSLKPEDTAVYYCATDPPLFWGQGTLVTVSS

SEQ ID NO: 1223 - protein, 114 aa, Artificial Sequence
  Description of Artificial Sequence: Synthetic polypeptide
EVQLVESGGGLVQPGGSLRLSCAASGRTFSDYTMGWFRQAPGKEREFVAAINWSGGYTYYADSVKGRFTISADNSKNTAYLQMNSLKPEDTAVYYCATDPPLFWGQGTLVTVSS

SEQ ID NO: 1224 - protein, 128 aa, Artificial Sequence
  Description of Artificial Sequence: Synthetic polypeptide
EVQLVESGGGLVQPGGSLRLSCAASGRTFGDYGMGWFRQAPGKEREFVATINWSGALTHYADSVKGRFTISADNSKNTAYLQMNSLKPEDTAVYYCATLPFYDFWSGYYTGYYYMDVWGQGTLVTVSS

SEQ ID NO: 1225 - protein, 114 aa, Artificial Sequence
  Description of Artificial Sequence: Synthetic polypeptide
EVQLVESGGGLVQPGGSLRLSCAASGRTFSDDTMGWFRQAPGKEREFLAGVTWSGSSTFYADSVKGRFTISADNSKNTAYLQMNSLKPEDTAVYYCATDPPLFWGQGTLVTVSS

SEQ ID NO: 1226 - protein, 114 aa, Artificial Sequence
  Description of Artificial Sequence: Synthetic polypeptide
EVQLVESGGGLVQPGGSLRLSCAASGRTFSDDIMGWFRQAPGKEREFVAAISWSGGNTHYADSVKGRFTISADNSKNTAYLQMNSLKPEDTAVYYCATDPPLFWGQGTLVTVSS

SEQ ID NO: 1227 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCATASPNTGWHFDHWGQGTLVTVSS

SEQ ID NO: 1228 - protein, 124 aa, Artificial Sequence
  Description of Artificial Sequence: Synthetic polypeptide
EVQLVESGGGLVQPGGSLRLSCAASGFTFDDDYVMGWFRQAPGKEREFVAAVSGSGDDTYYADSVKGRFTISADNSKNTAYLQMNSLKPEDTAVYYCAADRRGLASTRAADYDWGQGTLVTVSS

SEQ ID NO: 1229 - protein, 120 aa, Artificial Sequence
  Description of Artificial Sequence: Synthetic polypeptide
EVQLVESGGGLVQPGGSLRLSCAASGRTFGDYIMGWFRQAPGKEREFVAAINWSAGYTAYADSVKGRFTISADNSKNTAYLQMNSLKPEDTAVYYCATEPPLSCWHFDLWGQGTLVTVSS

SEQ ID NO: 1230 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSGGYTPYADSVKGRFTISADNSKNTAYLQMNSLKPEDTAVYYCATAPPNTGWHFDHWGQGTLVTVSS

SEQ ID NO: 1231 - protein, 120 aa, Artificial Sequence
  Description of Artificial Sequence: Synthetic polypeptide
EVQLVESGGGLVQPGGSLRLSCAASGRTFGDDTMGWFRQAPGKEREIVAAINWSAGYTPYADSVKGRFTISADNSKNTAYLQMNSLKPEDTAVYYCATDPPLFCCHFDLWGQGTLVTVSS

SEQ ID NO: 1232 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAISWSGGTTRYADSVKGRFTISADNSKNTAYLQMNSLKPEDTAVYYCATDPPLFWGQGTLVTVSS

SEQ ID NO: 1233 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGDSTYYADSVKGRFTISADNSKNTAYLQMNSLKPEDTAVYYCATDPPLFWGQGTLVTVSS

SEQ ID NO: 1234 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGGTTRYADSVKGRFTISADNSKNTAYLQMNSLKPEDTAVYYCATDPPLFWGQGTLVTVSS

SEQ ID NO: 1235 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAIHWSGSSTRYADSVKGRFTISADNSKNTAYLQMNSLKPEDTAVYYCATDPPLFWGQGTLVTVSS

SEQ ID NO: 1236 - protein, 114 aa, Artificial Sequence
  Description of Artificial Sequence: Synthetic polypeptide
EVQLVESGGGLVQPGGSLRLSCAASGRTFSDDTMGWFRQAPGKERELVGTINWSGGSTYYADSVKGRFTISADNSKNTAYLQMNSLKPEDTAVYYCATDPPLFWGQGTLVTVSS

SEQ ID NO: 1237 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWSGGYTPYADSVKGRFTISADNSKNTAYLQMNSLKPEDTAVYYCATDPPLFWGQGTLVTVSS

SEQ ID NO: 1238 - protein, 114 aa, Artificial Sequence
  Description of Artificial Sequence: Synthetic polypeptide
EVQLVESGGGLVQPGGSLRLSCAASGRTFGDDTMGWFRQAPGKERELVAAINWNGGNTHYADSVKGRFTISADNSKNTAYLQMNSLKPEDTAVYYCATDPPLFWGQGTLVTVSS

SEQ ID NO: 1239 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGGTTRYADSVKGRFTISADNSKNTAYLQMNSLKPEDTAVYYCATDPPLFWGQGTLVTVSS

SEQ ID NO: 1240 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTPYADSVKGRFTISADNSKNTAYLQMNSLKPEDTAVYYCATDPPLFWGHVDLWGQGTLVTVSS

SEQ ID NO: 1241 - protein, 114 aa, Artificial Sequence
  Description of Artificial Sequence: Synthetic polypeptide
EVQLVESGGGLVQPGGSLRLSCAASGRTFSDDTMGWFRQAPGKEREWVASINWSGGSTYYADSVKGRFTISADNSKNTAYLQMNSLKPEDTAVYYCATDPPLFWGQGTLVTVSS

SEQ ID NO: 1242 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAGISWNGGSIYYADSVKGRFTISADNSKNTAYLQMNSLKPEDTAVYYCATDPPLFWGQGTLVTVSS

SEQ ID NO: 1243 - protein, 123 aa, Artificial Sequence
  Description of Artificial Sequence: Synthetic polypeptide
EVQLVESGGGLVQPGGSLRLSCAASGFTFDDYEMGWFRQAPGKEREFVAAISWRGGTTYYADSVKGRFTISADNSKNTAYLQMNSLKPEDTAVYYCAADRRGLASTRAGDYDWGQGTLVTVSS

SEQ ID NO: 1244 - protein, 120 aa, Artificial Sequence
  Description of Artificial Sequence: Synthetic polypeptide
EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGHVDLWGQGTLVTVSS

SEQ ID NO: 1245 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGGSTRYADSVKGRFTISADNSKNTAYLQMNSLKPEDTAVYYCATDPPLFWGQGTLVTVSS

SEQ ID NO: 1246 - protein, 128 aa, Artificial Sequence
  Description of Artificial Sequence: Synthetic polypeptide
EVQLVESGGGLVQPGGSLRLSCAASGVTLDDYAMGWFRQAPGKEREFVAVINWSGGSTDYADSVKGRFTISADNSKNTAYLQMNSLKPEDTAVYYCARGGGWVPSSTSESLNWYFDRWGQGTLVTVSS

SEQ ID NO: 1247 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSGGTTPYADSVKGRFTISADNSKNTAYLQMNSLKPEDTAVYYCATDPPLFCCHVDLWGQGTLVTVSS

SEQ ID NO: 1248 - protein, 114 aa, Artificial Sequence
  Description of Artificial Sequence: Synthetic polypeptide
EVQLVESGGGLVQPGGSLRLSCAASGLTFSDDTMGWFRQAPGKEREFVAAVSWSGGNTYYADSVKGRFTISADNSKNTAYLQMNSLKPEDTAVYYCATDPPLFWGQGTLVTVSS

SEQ ID NO: 1249 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWTGGYTPYADSVKGRFTISADNSKNTAYLQMNSLKPEDTAVYYCATDPPLFWGQGTLVTVSS

SEQ ID NO: 1250 - protein, 120 aa, Artificial Sequence
  Description of Artificial Sequence: Synthetic polypeptide
EVQLVESGGGLVQPGGSLRLSCAASGRTFGDYIMGWFRQAPGKEREFVATINWTAGYTYYADSVKGRFTISADNSKNTAYLQMNSLKPEDTAVYYCATDPPLFCWHFDHWGQGTLVTVSS

SEQ ID NO: 1251 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGNTDYADSVKGRFTISADNSKNTAYLQMNSLKPEDTAVYYCATDPPLFWGQGTLVTVSS

SEQ ID NO: 1252 - protein, 114 aa, Artificial Sequence
  Description of Artificial Sequence: Synthetic polypeptide
EVQLVESGGGLVQPGGSLRLSCAASGRTFGDYTMGWFRQAPGKEREFVAAINWSGGNTYYADSVKGRFTISADNSKNTAYLQMNSLKPEDTAVYYCATDPPLFWGQGTLVTVSS

SEQ ID NO: 1253 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAGINWSGNGVYYADSVKGRFTISADNSKNTAYLQMNSLKPEDTAVYYCATDPPLFWGQGTLVTVSS

SEQ ID NO: 1254 - protein, 114 aa, Artificial Sequence
  Description of Artificial Sequence: Synthetic polypeptide
EVQLVESGGGLVQPGGSLRLSCAASGRTFGDYAMGWFRQAPGKERELVAPINWSGGSTYYADSVKGRFTISADNSKNTAYLQMNSLKPEDTAVYYCATDPPLFWGQGTLVTVSS

SEQ ID NO: 1255 - protein, 118 aa, Artificial Sequence
  Description of Artificial Sequence: Synthetic polypeptide
EVQLVESGGGLVQPGGSLRLSCAASGGTFSNSGMGWFRQAPGKERELVAVVNWSGRRTYYADSVKGRFTISADNSKNTAYLQMNSLKPEDTAVYYCAVPWMDYNRRDWGQGTLVTVSS

SEQ ID NO: 1256 - protein, 118 aa, Artificial Sequence
  Description of Artificial Sequence: Synthetic polypeptide
EVQLVESGGGLVQPGGSLRLSCAASGQLANFASYAMGWFRQAPGKEREFVAAITRSGSSTVYADSVKGRFTISADNSKNTAYLQMNSLKPEDTAVYYCATTMNPNPRWGQGTLVTVSS

SEQ ID NO: 1257 - protein, 114 aa, Artificial Sequence
  Description of Artificial Sequence: Synthetic polypeptide
EVQLVESGGGLVQPGGSLRLSCAASGRTFSDDIMGWFRQAPGKEREFVAAINWTGGSTYYADSVKGRFTISADNSKNTAYLQMNSLKPEDTAVYYCATDPPLFWGQGTLVTVSS

SEQ ID NO: 1258 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATARPNTGWHFDHWGQGTLVTVSS

SEQ ID NO: 1259 - protein, 114 aa, Artificial Sequence
  Description of Artificial Sequence: Synthetic polypeptide
EVQLVESGGGLVQPGGSLRLSCAASGRTFSDDTMGWFRQAPGKEREWVGSINWSGGSTYYADSVKGRFTISADNSKNTAYLQMNSLKPEDTAVYYCATDPPLFWGQGTLVTVSS

SEQ ID NO: 1260 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAGMTWSGSSTFYADSVKGRFTISADNSKNTAYLQMNSLKPEDTAVYYCATDPPLFWGQGTLVTVSS

SEQ ID NO: 1261 - protein, 114 aa, Artificial Sequence
  Description of Artificial Sequence: Synthetic polypeptide
EVQLVESGGGLVQPGGSLRLSCAASGRTFGDYIMGWFRQAPGKERECVAAINWSGDYTDYADSVKGRFTISADNSKNTAYLQMNSLKPEDTAVYYCATDPPLFWGQGTLVTVSS

SEQ ID NO: 1262 - protein, 114 aa, Artificial Sequence
  Description of Artificial Sequence: Synthetic polypeptide
EVQLVESGGGLVQPGGSLRLSCAASGRTFGDYIMGWFRQAPGKEREFVGGINWSGGYTYYADSVKGRFTISADNSKNTAYLQMNSLKPEDTAVYYCATDPPLFWGQGTLVTVSS

SEQ ID NO: 1263 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAVNWSGGSTYYADSVKGRFTISADNSKNTAYLQMNSLKPEDTAVYYCATDPPLFWGQGTLVTVSS

SEQ ID NO: 1264 - protein, 114 aa, Artificial Sequence
  Description of Artificial Sequence: Synthetic polypeptide
EVQLVESGGGLVQPGGSLRLSCAASGRTFGDYAMGWFRQAPGKEREFVAAINWSGGYTRYADSVKGRFTISADNSKNTAYLQMNSLKPEDTAVYYCATDPPLFWGQGTLVTVSS

SEQ ID NO: 1265 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGYTPYADSVKGRFTISADNSKNTAYLQMNSLKPEDTAVYYCATDPPLFWGQGTLVTVSS

SEQ ID NO: 1266 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCARASPNTGWHFDRWGQGTLVTVSS

SEQ ID NO: 1267 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWSGGYTHYADSVKGRFTISADNSKNTAYLQMNSLKPEDTAVYYCATDPPLFWGQGTLVTVSS

SEQ ID NO: 1268 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAITWSGGRTRYADSVKGRFTISADNSKNTAYLQMNSLKPEDTAVYYCATDRPLFWGQGTLVTVSS

SEQ ID NO: 1269 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSGGYTAYADSVKGRFTISADNSKNTAYLQMNSLKPEDTAVYYCATASPNTGWHFDHWGQGTLVTVSS

SEQ ID NO: 1270 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAIHWSGSSTRYADSVKGRFTISADNSKNTAYLQMNSLKPEDTAVYYCATDPPLFWGQGTLVTVSS

SEQ ID NO: 1271 - protein, 114 aa, Artificial Sequence
  Description of Artificial Sequence: Synthetic polypeptide
EVQLVESGGGLVQPGGSLRLSCAASGRTFSDYTMGWFRQAPGKEREWVAAINWSGGTTYYADSVKGRFTISADNSKNTAYLQMNSLKPEDTAVYYCATDPPLFWGQGTLVTVSS

SEQ ID NO: 1272 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGDNTHYADSVKGRFTISADNSKNTAYLQMNSLKPEDTAVYYCATDPPLFWGQGTLVTVSS

SEQ ID NO: 1273 - protein, 118 aa, Artificial Sequence
  Description of Artificial Sequence: Synthetic polypeptide
EVQLVESGGGLVQPGGSLRLSCAASGFAFGDNWIGWFRQAPGKEREWVASISSGGTTAYADNVKGRFTIIADNSKNTAYLQMNSLKPEDTAVYYCAHRGGWLRPWGYWGQGTLVTVSS

SEQ ID NO: 1274 - protein, 114 aa, Artificial Sequence
  Description of Artificial Sequence: Synthetic polypeptide
EVQLVESGGGLVQPGGSLRLSCAASGRTFSDDAMGWFRQAPGKEREFVGRINWSGGNTYYADSVKGRFTISADNSKNTAYLQMNSLKPEDTAVYYCATDPPLFWGQGTLVTVSS

SEQ ID NO: 1275 - protein, 114 aa, Artificial Sequence
  Description of Artificial Sequence: Synthetic polypeptide
EVQLVESGGGLVQPGGSLRLSCAASGRTFSDDTMGWFRQAPGKEREFVGGISWSGGNTYYADSVKGRFTISADNSKNTAYLQMNSLKPEDTAVYYCATDPPLFWGQGTLVTVSS

SEQ ID NO: 1276 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGGSTYYADSVKGRFTISADNSKNTAYLQMNSLKPEDTAVYYCATDPPLFWGQGTLVTVSS

SEQ ID NO: 1277 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGYTYYADSVKGRFTISADNSKNTAYLQMNSLKPEDTAVYYCATDPPLFWGQGTLVTVSS

SEQ ID NO: 1278 - protein, 120 aa, Artificial Sequence
  Description of Artificial Sequence: Synthetic polypeptide
EVQLVESGGGLVQPGGSLRLSCAASGRTFGDYIMGWFRQAPGKEREFVAAINWSADYTAYADSVKGRFTISADNSKNTAYLQMNSLKPEDTAVYYCATDPPLFCWHFDHWGQGTLVTVSS

SEQ ID NO: 1279 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGSSTYYADSVKGRFTISADNSKNTAYLQMNSLKPEDTAVYYCATDPPLFWGQGTLVTVSS

SEQ ID NO: 1280 - protein, 120 aa, Artificial Sequence
  Description of Artificial Sequence: Synthetic polypeptide
EVQLVESGGGLVQPGGSLRLSCAASGRTFGDYIMGWFRQAPGKEREMVAAINWIAGYTADADSVRRLFTITADNNKNTAHLMMNLLKPENTAVYYCAEPSPNTGWHFDHWGQGTLVTVSS

SEQ ID NO: 1281 - protein, 114 aa, Artificial Sequence
  Description of Artificial Sequence: Synthetic polypeptide
EVQLVESGGGLVQPGGSLRLSCAASGRTFGDDTMGWFRQAPGKEREFVAAINWSGGNTPYADSVKGRFTISADNSKNTAYLQMNSLKPEDTAVYYCATDPPLFWGQGTLVTVSS

SEQ ID NO: 1282 - protein, 114 aa, Artificial Sequence
  Description of Artificial Sequence: Synthetic polypeptide
EVQLVESGGGLVQPGGSLRLSCAASGRTFSDDTMGWFRQAPGKEREFVAAINWSGDNTHYADSVKGRFTISADNSKNTAYLQMNSLKPEDTAVYYCATDPPLFWGQGTLVTVSS

SEQ ID NO: 1283 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGRFTISADNSKNTAYLQMNSLKPEDTAVYYCATAPPLFCWHFDHWGQGTLVTVSS

SEQ ID NO: 1284 - protein, 120 aa, Artificial Sequence
  Description of Artificial Sequence: Synthetic polypeptide
EVQLVESGGGLVQPGGSLRLSCAASGFTFGDYVMGWFRQAPGKEREIVAAINWNAGYTAYADSVRGLFTITADNSKNTAYLQMNSLKPEDTAVYYCAKASPNTGWHFDHWGQGTLVTVSS

SEQ ID NO: 1285 - protein, 114 aa, Artificial Sequence
  Description of Artificial Sequence: Synthetic polypeptide
EVQLVESGGGLVQPGGSLRLSCAASGRTFGDYTMGWFRQAPGKEREFVAAINWTGGYTYYADSVKGRFTISADNSKNTAYLQMNSLKPEDTAVYYCATDPPLFWGQGTLVTVSS

SEQ ID NO: 1286 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTAYADSVKGLFTITADNSKNTAYLQMNILKPEDTAVYYCARATPNTGWHFDHWGQGTLVTVSS

SEQ ID NO: 1287 - protein, 114 aa, Artificial Sequence
  Description of Artificial Sequence: Synthetic polypeptide
EVQLVESGGGLVQPGGSLRLSCAASGRTFGDYIMGWFRQAPGKEREFVAAINWSGDNTHYADSVKGRFTISADNSKNTAYLQMNSLKPEDTAVYYCATDPPLFWGQGTLVTVSS

SEQ ID NO: 1288 - protein, 120 aa, Artificial Sequence
  Description of Artificial Sequence: Synthetic polypeptide
EVQLVESGGGLVQPGGSLRLSCAASGRTFGDYIMGWFRQAPGKEREIVAAINWSAGYTPYADSVKGRFTISADNSKNTAYLQMNSLKPEDTAVYYCATDPPLFCCHFDHWGQGTLVTVSS

SEQ ID NO: 1289 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWSAGYTAYADSVKGRFTISADNSKNTAYLQMNSLKPEDTAVYYCATAPPNTGWHFDHWGQGTLVTVSS

SEQ ID NO: 1290 - protein, 123 aa, Artificial Sequence
  Description of Artificial Sequence: Synthetic polypeptide
EVQLVESGGGLVQPGGSLRLSCAASGFTWGDYTMGWFRQAPGKEREFVAAINWSGGNTYYADSVKGRFTISADNSKNTAYLQMNSLKPEDTAVYYCAADRRGLASTRAADYDWGQGTLVTVSS

SEQ ID NO: 1291 - protein, 122 aa, Artificial Sequence
  Description of Artificial Sequence: Synthetic polypeptide
EVQLVESGGGLVQPGGSLRLSCAASGIPSTLRAMGWFRQAPGKEREFVAAVSSLGPFTRYADSVKGRFTISADNSKNTAYLQMNSLKPEDTAVYYCAAKPGWVARDPSQYNWGQGTLVTVSS

SEQ ID NO: 1292 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAINWSGGSTYYADSVKGRFTISADNSKNTAYLQMNSLKPEDTAVYYCAADRRGLASTRAADYDWGQGTLVTVSS

SEQ ID NO: 1293 - protein, 116 aa, Artificial Sequence
  Description of Artificial Sequence: Synthetic polypeptide
EVQLVESGGGLVQPGGSLRLSCAASGRTFSNAAMGWFRQAPGKEREFVARILWTGASRSYADSVKGRFTISADNSKNTAYLQMNSLKPEDTAVYYCATTENPNPRWGQGTLVTVSS

SEQ ID NO: 1294 - protein, 120 aa, Artificial Sequence
  Description of Artificial Sequence: Synthetic polypeptide
EVQLVESGGGLVQPGGSLRLSCAASGGTFGVYHMGWFRQAPGKEREGVAAINMSGDDSAYADSVKGRFTISADNSKNTAYLQMNSLKPEDTAVYYCAILVGPGQVEFDHWGQGTLVTVSS

SEQ ID NO: 1295 - protein, 124 aa, Artificial Sequence
  Description of Artificial Sequence: Synthetic polypeptide
EVQLVESGGGLVQPGGSLRLSCAASGFTFSSYYMGWFRQAPGKEREFVARISGSTFYADSVKGRFTISADNSKNTAYLQMNSLKPEDTAVYYCAALPFVCPSGSYSDYGDEYDWGQGTLVTVSS

SEQ ID NO: 1296 - protein, 114 aa, Artificial Sequence
  Description of Artificial Sequence: Synthetic polypeptide
EVQLVESGGGLVQPGGSLRLSCAASGRTFSGDFMGWFRQAPGKEREFVGRINWSGGNTYYADSVRGLFTITADNNKNTAYLMMNLLKPEDTAVYYCPTDPPLFWGLGTLVTWSS

SEQ ID NO: 1297 - protein, 119 aa, Artificial Sequence
  Description of Artificial Sequence: Synthetic polypeptide
EVQLVESGGGLVQPGGSLRLSCAASGSTLRDYAMGWFRQAPGKERESVAAITWSGGSTAYADSVKGRFTISADNSKNTAYLQMNSLKPEDTAVYYCASLLAGDRYFDYWGQGTLVTVSS

SEQ ID NO: 1298 - protein, 123 aa, Artificial Sequence
  Description of Artificial Sequence: Synthetic polypeptide
EVQLVESGGGLVQPGGSLRLSCAASGFTFDDYTMGWFRQAPGKEREFVAAITDNGGSKYYADSVKGRFTISADNSKNTAYLQMNSLKPEDTAVYYCAADRRGLASTRAADYDWGQGTLVTVSS

SEQ ID NO: 1299 - protein, 122 aa, Artificial Sequence
  Description of Artificial Sequence: Synthetic polypeptide
EVQLVESGGGLVQPGGSLRLSCAASGGTFSSYGMGWFRQAPGKEREFVAAINWSGASTYYADSVKGRFTISADNSKNTAYLQMNSLKPEDTAVYYCARDWRDRTWGNSLDYWGQGTLVTVSS

SEQ ID NO: 1300 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAISWSEDNTYYADSVKGRFTISADNSKNTAYLQMNSLKPEDTAVYYCAADRRGLASTRAADYDWGQGTLVTVSS

SEQ ID NO: 1301 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAVSGSGDDTYYADSVKGRFTISADNSKNTAYLQMNSLKPEDTAVYYCAADRRGLASTRAADYDWGQGTLVTVSS

SEQ ID NO: 1302 - protein, 126 aa, Artificial Sequence
  Description of Artificial Sequence: Synthetic polypeptide
EVQLVESGGGLVQPGGSLRLSCAASGNIAAINVMGWFRQAPGKEREFVAAISASGRRTDYADSVKGRFTISADNSKNTAYLQMNSLKPEDTAVYYCARRVYYYDSSGPPGVTFDIWGQGTLVTVSS

SEQ ID NO: 1303 - protein, 118 aa, Artificial Sequence
  Description of Artificial Sequence: Synthetic polypeptide
EVQLVESGGGLVQPGGSLRLSCAASGIITSRYVMGWFRQAPGKEREGVAAISTGGSTIYADSVKGRFTISADNSKNTAYLQMNSLKPEDTAVYYCARQDSSSPYFDYWGQGTLVTVSS

SEQ ID NO: 1304 - protein, 124 aa, Artificial Sequence
  Description of Artificial Sequence: Synthetic polypeptide
EVQLVESGGGLVQPGGSLRLSCAASGFSFDDDYVMGWFRQAPGKEREFVAAISNSGLSTYYADSVKGRFTISADNSKNTAYLQMNSLKPEDTAVYYCAADRRGLASTRAADYDWGQGTLVTVSS

SEQ ID NO: 1305 - protein, 126 aa, Artificial Sequence
  Description of Artificial Sequence: Synthetic polypeptide
EVQLVESGGGLVQPGGSLRLSCAASGSISSINVMGWFRQAPGKEREFVATMRWSTGSTYYADSVKGRFTISADNSKNTAYLQMNSLKPEDTAVYYCAQRVRGFFGPLRTTPSWYEWGQGTLVTVSS

SEQ ID NO: 1306 - protein, 127 aa, Artificial Sequence
  Description of Artificial Sequence: Synthetic polypeptide
EVQLVESGGGLVQPGGSLRLSCAASGLTFILYRMGWFRQAPGKEREFVAAINNFGTTKYADSVKGRFTISADNSKNTAYLQMNSLKPEDTAVYYCARTHYDFWSGYTSRTPNYFDYWGQGTLVTVSS

SEQ ID NO: 1307 - protein, 120 aa, Artificial Sequence
  Description of Artificial Sequence: Synthetic polypeptide
EVQLVESGGGLVQPGGSLRLSCAASGGTFSVYHMGWFRQAPGKEREPVAAISWSGGSTAYADSVKGRFTISADNSKNTAYLQMNSLKPEDTAVYYCAAVNTWTSPSFDSWGQGTLVTVSS

SEQ ID NO: 1308 - protein, 120 aa, Artificial Sequence
  Description of Artificial Sequence: Synthetic polypeptide
EVQLVESGGGLVQPGGSLRLSCAASGRAFSTYGMGWFRQAPGKEREFVAGINWSGDTPYYADSVKGRFTISADNSKNTAYLQMNSLKPEDTAVYYCAREVGPPPGYFDLWGQGTLVTVSS

SEQ ID NO: 1309 - protein, 123 aa, Artificial Sequence
  Description of Artificial Sequence: Synthetic polypeptide
EVQLVESGGGLVQPGGSLRLSCAASGRTFSDIAMGWFRQAPGKEREFVASINWGGGNTYYADSVKGRFTISADNSKNTAYLQMNSLKPEDTAVYYCAAKGIWDYLGRRDFGDWGQGTLVTVSS

SEQ ID NO: 1310 - protein, 116 aa, Artificial Sequence
  Description of Artificial Sequence: Synthetic polypeptide
EVQLVESGGGLVQPGGSLRLSCAASGRTFSSARMGWFRQAPGKEREFVAAISWSGDNTHYADSVKGRFTISADNSKNTAYLQMNSLKPEDTAVYYCATTENPNPRWGQGTLVTVSS

SEQ ID NO: 1311 - protein, 115 aa, Artificial Sequence
  Description of Artificial Sequence: Synthetic polypeptide
EVQLVESGGGLVQPGGSLRLSCAASGFAFSSYAMGWFRQAPGKEREWVATINGDDYTYYADSVKGRFTISADNSKNTAYLQMNSLKPEDTAVYYCVATPGGYGLWGQGTLVTVSS

SEQ ID NO: 1312 - protein, 125 aa, Artificial Sequence
  Description of Artificial Sequence: Synthetic polypeptide
EVQLVESGGGLVQPGGSLRLSCAASGITFRRHDMGWFRQAPGKEREFVAAIRWSSSSTVYADSVKGRFTISADNSKNTAYLQMNSLKPEDTAVYYCAADRGVYGGRWYRTSQYTWGQGTLVTVSS

SEQ ID NO: 1313 - protein, 119 aa, Artificial Sequence
  Description of Artificial Sequence: Synthetic polypeptide
EVQLVESGGGLVQPGGSLRLSCAASGTAASFNPMGWFRQAPGKEREFVAAITSGGSTNYADSVKGRFTISADNSKNTAYLQMNSLKPEDTAVYYCAAIAYEEGVYRWDWGQGTLVTVSS

SEQ ID NO: 1314 - protein, 119 aa, Artificial Sequence
  Description of Artificial Sequence: Synthetic polypeptide
EVQLVESGGGLVQPGGSLRLSCAASGNINIINYMGWFRQAPGKEREGVAAIHWNGDSTAYADSVKGRFTISADNSKNTAYLQMNSLKPEDTAVYYCASGPPYSNYFAYWGQGTLVTVSS

SEQ ID NO: 1315 - protein, 120 aa, Artificial Sequence
  Description of Artificial Sequence: Synthetic polypeptide
EVQLVESGGGLVQPGGSLRLSCAASGFTFDDYAMGWFRQAPGKERESVAAISGSGGSTAYADSVKGRFTISADNSKNTAYLQMNSLKPEDTAVYYCAKIMGSGRPYFDHWGQGTLVTVSS

SEQ ID NO: 1316 - protein, 119 aa, Artificial Sequence
  Description of Artificial Sequence: Synthetic polypeptide
EVQLVESGGGLVQPGGSLRLSCAASGNIFTRNVMGWFRQAPGKEREFVAAITSSGSTNYADSVKGRFTISADNSKNTAYLQMNSLKPEDTAVYYCARPSSDLQGGVDYWGQGTLVTVSS

SEQ ID NO: 1317 - protein, 123 aa, Artificial Sequence
  Description of Artificial Sequence: Synthetic polypeptide
EVQLVESGGGLVQPGGSLRLSCAASGRTFSSIAMGWFRQAPGKEREFVASINWGGGNTIYADSVKGRFTISADNSKNTAYLQMNSLKPEDTAVYYCAAKGIWDYLGRRDFGDWGQGTLVTVSS

SEQ ID NO: 1318 - protein, 122 aa, Artificial Sequence
  Description of Artificial Sequence: Synthetic polypeptide
EVQLVESGGGLVQPGGSLRLSCAASGIPSTLRAMGWFRQAPGKEREFVAAVSSLGPFTRYADSVKGRFTISADNSKNTAYLQMNSLKPEDTAVYYCAAKPGWVARDPSEYNWGQGTLVTVSS

SEQ ID NO: 1319 - protein, 118 aa, Artificial Sequence
  Description of Artificial Sequence: Synthetic polypeptide
EVQLVESGGGLVQPGGSLRLSCAASGFTLDDSAMGWFRQAPGKEREWVAAITNGGSTYYADSVKGRFTISADNSKNTAYLQMNSLKPEDTAVYYCARFARGSPYFDFWGQGTLVTVSS

SEQ ID NO: 1320 - protein, 120 aa, Artificial Sequence
  Description of Artificial Sequence: Synthetic polypeptide
EVQLVESGGGLVQPGGSLRLSCAASGSISSFNAMGWFRQAPGKERESVAAIDWDGSTAYADSVKGRFTISADNSKNTAYLQMNSLKPEDTAVYYCARGGGYYGSGSFEYWGQGTLVTVSS

SEQ ID NO: 1321 - protein, 122 aa, Artificial Sequence
  Description of Artificial Sequence: Synthetic polypeptide
EVQLVESGGGLVQPGGSLRLSCAASGNIFSDNIIGWFRQAPGKEREMVAYYTSGGSIDYADSVKGRFTISADNSKNTAYLQMNSLKPEDTAVYYCARGTAVGRPPPGGMDVWGQGTLVTVSS

SEQ ID NO: 1322 - protein, 119 aa, Artificial Sequence
  Description of Artificial Sequence: Synthetic polypeptide
EVQLVESGGGLVQPGGSLRLSCAASGSISSIGAMGWFRQAPGKEREGVAAISSSGSSTVYADSVKGRFTISADNSKNTAYLQMNSLKPEDTAVYYCARVPPGQAYFDSWGQGTLVTVSS

SEQ ID NO: 1323 - protein, 123 aa, Artificial Sequence
  Description of Artificial Sequence: Synthetic polypeptide
EVQLVESGGGLVQPGGSLRLSCAASGFTFDDYGMGWFRQAPGKERELVATITWSGDSTYYADSVKGRFTISADNSKNTAYLQMNSLKPEDTAVYYCAKGGSWYYDSSGYYGRWGQGTLVTVSS

SEQ ID NO: 1324 - protein, 118 aa, Artificial Sequence
  Description of Artificial Sequence: Synthetic polypeptide
EVQLVESGGGLVQPGGSLRLSCAASGRTFSNYTMGWFRQAPGKEREWVSAISWSTGSTYYADSVKGRFTISADNSKNTAYLQMNSLKPEDTAVYYCAADRYGPPWYDWGQGTLVTVSS

SEQ ID NO: 1325 - protein, 116 aa, Artificial Sequence
  Description of Artificial Sequence: Synthetic polypeptide
EVQLVESGGGLVQPGGSLRLSCAASGSTNYMGWFRQAPGKEREGVAAISMSGDDTIYADSVKGRFTISADNSKNTAYLQMNSLKPEDTAVYYCARIGLRGRYFDLWGQGTLVTVSS

SEQ ID NO: 1326 - protein, 118 aa, Artificial Sequence
  Description of Artificial Sequence: Synthetic polypeptide
EVQLVESGGGLVQPGGSLRLSCAASGGTFSSVGMGWFRQAPGKERELVAVINWSGARTYYADSVKGRFTISADNSKNTAYLQMNSLKPEDTAVYYCAVPWMDYNRRDWGQGTLVTVSS

SEQ ID NO: 1327 - protein, 118 aa, Artificial Sequence
  Description of Artificial Sequence: Synthetic polypeptide
EVQLVESGGGLVQPGGSLRLSCAASGRIFTNTAMGWFRQAPGKEREGVAAINWSGGSTAYADSVKGRFTISADNSKNTAYLQMNSLKPEDTAVYYCARTSGSYSFDYWGQGTLVTVSS

SEQ ID NO: 1328 - protein, 123 aa, Artificial Sequence
  Description of Artificial Sequence: Synthetic polypeptide
EVQLVESGGGLVQPGGSLRLSCAASGEEFSDHWMGWFRQAPGKEREFVGAIHWSGGRTYYADSVKGRFTISADNSKNTAYLQMNSLKPEDTAVYYCAADRRGLASTRAADYDWGQGTLVTVSS

SEQ ID NO: 1329 - protein, 123 aa, Artificial Sequence
  Description of Artificial Sequence: Synthetic polypeptide
EVQLVESGGGLVQPGGSLRLSCAASGRTFSSIAMGWFRQAPGKEREFVAAINWSGARTAYADSVKGRFTISADNSKNTAYLQMNSLKPEDTAVYYCAAKGIWDYLGRRDFGDWGQGTLVTVSS

SEQ ID NO: 1330 - protein, 119 aa, Artificial Sequence
  Description of Artificial Sequence: Synthetic polypeptide
EVQLVESGGGLVQPGGSLRLSCAASGSTSSLRTMGWFRQAPGKEREGVAAISSRDGSTIYADSVKGRFTISADNSKNTAYLQMNSLKPEDTAVYYCARDDSSSPYFDYWGQGTLVTVSS

SEQ ID NO: 1331 - protein, 121 aa, Artificial Sequence
  Description of Artificial Sequence: Synthetic polypeptide
EVQLVESGGGLVQPGGSLRLSCAASGGGTFGSYAMGWFRQAPGKEREFVAAISIASGASGGTTNYADSVKGRFTISADNSKNTAYLQMNSLKPEDTAVYYCATTMNPNPRWGQGTLVTVSS

SEQ ID NO: 1332 - protein, 116 aa, Artificial Sequence
  Description of Artificial Sequence: Synthetic polypeptide
EVQLVESGGGLVQPGGSLRLSCAASGRTFSNAAMGWFRQAPGKEREFVARITWNGGSTFYADSVKGRFTISADNSKNTAYLQMNSLKPEDTAVYYCATTENPNPRWGQGTLVTVSS

SEQ ID NO: 1333 - protein, 123 aa, Artificial Sequence
  Description of Artificial Sequence: Synthetic polypeptide
EVQLVESGGGLVQPGGSLRLSCAASGIILSDNAMGWFRQAPGKEREFVAAISWLGESTYYADSVKGRFTISADNSKNTAYLQMNSLKPEDTAVYYCAADRRGLASTRAADYDWGQGTLVTVSS

SEQ ID NO: 1334 - protein, 120 aa, Artificial Sequence
  Description of Artificial Sequence: Synthetic polypeptide
EVQLVESGGGLVQPGGSLRLSCAASGRTFGDYIMGWFRQAPGKERESVAAINWNGGYTAYADSVKGRFTISADNSKNTAYLQMNSLKPEDTAVYYCATTSPNTGWHYYRWGQGTLVTVSS

SEQ ID NO: 1335 - protein, 128 aa, Artificial Sequence
  Description of Artificial Sequence: Synthetic polypeptide
EVQLVESGGGLVQPGGSLRLSCAASGFNFNWYPMGWFRQAPGKERESVAAISWTGVSTYTAYADSVKGRFTISADNSKNTAYLQMNSLKPEDTAVYYCARWGPGPAGGSPGLVGFDYWGQGTLVTVSS

SEQ ID NO: 1336 - protein, 116 aa, Artificial Sequence
  Description of Artificial Sequence: Synthetic polypeptide
EVQLVESGGGLVQPGGSLRLSCAASGSIRSVSVMGWFRQAPGKEREAVAAISWSGVGTAYADSVKGRFTISADNSKNTAYLQMNSLKPEDTAVYYCAAYQRGWGDWGQGTLVTVSS

SEQ ID NO: 1337 - protein, 122 aa, Artificial Sequence
  Description of Artificial Sequence: Synthetic polypeptide
EVQLVESGGGLVQPGGSLRLSCAASGMTFRLYAMGWFRQAPGKEREFVGAINWLSESTYYADSVKGRFTISADNSKNTAYLQMNSLKPEDTAVYYCAAKPGWVARDPSEYNWGQGTLVTVSS

SEQ ID NO: 1338 - protein, 114 aa, Artificial Sequence
  Description of Artificial Sequence: Synthetic polypeptide
EVQLVESGGGLVQPGGSLRLSCAASGRTFSDDAMGWFRQAPGKEREFVAAINWSGGSTYYADSVKGRFTISADNSKNTAYLQMNSLKPEDTAVYYCATDPPLFWGQGTMVTVSS

SEQ ID NO: 1339 - protein, 125 aa, Artificial Sequence
  Description of Artificial Sequence: Synthetic polypeptide
EVQLVESGGGLVQPGGSLRLSCAASGGTFSVYAMGWFRQAPGKEREGVAAISMSGDDAAYADSVKGRFTISADNSKNTAYLQMNSLKPEDTAVYYCAKISKDDGGKPRGAFFDSWGQGTLVTVSS

SEQ ID NO: 1340 - protein, 120 aa, Artificial Sequence
  Description of Artificial Sequence: Synthetic polypeptide
EVQLVESGGGLVQPGGSLRLSCAASGFALGYYAMGWFRQAPGKERESVAAISSRDGSTAYADSVKGRFTISADNSKNTAYLQMNSLKPEDTAVYYCARLATGPQAYFHHWGQGTLVTVSS

SEQ ID NO: 1341 - protein, 119 aa, Artificial Sequence
  Description of Artificial Sequence: Synthetic polypeptide
EVQLVESGGGLVQPGGSLRLSCAASGFNLDDYAMGWFRQAPGKERESVAAISWDGGATAYADSVKGRFTISADNSKNTAYLQMNSLKPEDTAVYYCARVGRGTTAFDSWGQGTLVTVSS

SEQ ID NO: 1342 - protein, 125 aa, Artificial Sequence
  Description of Artificial Sequence: Synthetic polypeptide
EVQLVESGGGLVQPGGSLRLSCAASGNTFSGGFMGWFRQAPGKEREFVASIRSGARTYYADSVKGRFTISADNSKNTAYLQMNSLKPEDTAVYYCAQRVRGFFGPLRTTPSWYEWGQGTLVTVSS

SEQ ID NO: 1343 - protein, 119 aa, Artificial Sequence
  Description of Artificial Sequence: Synthetic polypeptide
EVQLVESGGGLVQPGGSLRLSCAASGSIRSINIMGWFRQAPGKEREAVAAISWSGGSTVYADSVKGRFTISADNSKNTAYLQMNSLKPEDTAVYYCASLLAGDRYFDYWGQGTLVTVSS

SEQ ID NO: 1344 - protein, 9 aa, Artificial Sequence
  Description of Artificial Sequence: Synthetic peptide
GTFSSIGMG

SEQ ID NO: 1345 - protein, 9 aa, Artificial Sequence
  Description of Artificial Sequence: Synthetic peptide
LRFDDYAMG

SEQ ID NO: 1346 - protein, 9 aa, Artificial Sequence
  Description of Artificial Sequence: Synthetic peptide
SIFSIDVMG

SEQ ID NO: 1347 - protein, 9 aa, Artificial Sequence
  Description of Artificial Sequence: Synthetic peptide
FTLADYAMG

SEQ ID NO: 1348 - protein, 9 aa, Artificial Sequence
  Description of Artificial Sequence: Synthetic peptide
RTFSSIAMG

SEQ ID NO: 1349 - protein, 10 aa, Artificial Sequence
  Description of Artificial Sequence: Synthetic peptide
PTFSSYAMMG

SEQ ID NO: 1350 - protein, 6 aa, Artificial Sequence
  Description of Artificial Sequence: Synthetic peptide
STGYMG

SEQ ID NO: 1351 - protein, 9 aa, Artificial Sequence
  Description of Artificial Sequence: Synthetic peptide
RPFSEYTMG

SEQ ID NO: 1352 - protein, 9 aa, Artificial Sequence
  Description of Artificial Sequence: Synthetic peptide
LTLSTYGMG

SEQ ID NO: 1353 - protein, 9 aa, Artificial Sequence
  Description of Artificial Sequence: Synthetic peptide
FTFNNHNMG

SEQ ID NO: 1354 - protein, 7 aa, Artificial Sequence
  Description of Artificial Sequence: Synthetic peptide
GIYRVMG

SEQ ID NO: 1355 - protein, 9 aa, Artificial Sequence
  Description of Artificial Sequence: Synthetic peptide
YTDSNLWMG

SEQ ID NO: 1356 - protein, 9 aa, Artificial Sequence
  Description of Artificial Sequence: Synthetic peptide
FTFDYYTMG

SEQ ID NO: 1357 - protein, 9 aa, Artificial Sequence
  Description of Artificial Sequence: Synthetic peptide
GIFSINVMG

SEQ ID NO: 1358 - protein, 9 aa, Artificial Sequence
  Description of Artificial Sequence: Synthetic peptide
FTFDGAAMG

SEQ ID NO: 1359 - protein, 9 aa, Artificial Sequence
  Description of Artificial Sequence: Synthetic peptide
RTHSIYPMG

SEQ ID NO: 1360 - protein, 9 aa, Artificial Sequence
  Description of Artificial Sequence: Synthetic peptide
PTFSIYAMG

SEQ ID NO: 1361 - protein, 11 aa, Artificial Sequence
  Description of Artificial Sequence: Synthetic peptide
LTFDDNIHVMG

SEQ ID NO: 1362 - protein, 9 aa, Artificial Sequence
  Description of Artificial Sequence: Synthetic peptide
LTLDYYAMG

SEQ ID NO: 1363 - protein, 9 aa, Artificial Sequence
  Description of Artificial Sequence: Synthetic peptide
RTIVPYTMG

SEQ ID NO: 1364 - protein, 9 aa, Artificial Sequence
  Description of Artificial Sequence: Synthetic peptide
GTFTTYHMG

SEQ ID NO: 1365 - protein, 9 aa, Artificial Sequence
  Description of Artificial Sequence: Synthetic peptide
FTFNVFAMG

SEQ ID NO: 1366 - protein, 9 aa, Artificial Sequence
  Description of Artificial Sequence: Synthetic peptide
SIFSIDVMG

SEQ ID NO: 1367 - protein, 9 aa, Artificial Sequence
  Description of Artificial Sequence: Synthetic peptide
FTFSSYSMG

SEQ ID NO: 1368 - protein, 9 aa, Artificial Sequence
  Description of Artificial Sequence: Synthetic peptide
NTFSINVMG

SEQ ID NO: 1369 - protein, 9 aa, Artificial Sequence
  Description of Artificial Sequence: Synthetic peptide
RTISSYIMG

SEQ ID NO: 1370 - protein, 9 aa, Artificial Sequence
  Description of Artificial Sequence: Synthetic peptide
RANSINWMG

SEQ ID NO: 1371 - protein, 9 aa, Artificial Sequence
  Description of Artificial Sequence: Synthetic peptide
GTFSVFAMG

SEQ ID NO: 1372 - protein, 9 aa, Artificial Sequence
  Description of Artificial Sequence: Synthetic peptide
FTFDDYPMG

SEQ ID NO: 1373 - protein, 9 aa, Artificial Sequence
  Description of Artificial Sequence: Synthetic peptide
FALGYYAMG

SEQ ID NO: 1374 - protein, 9 aa, Artificial Sequence
  Description of Artificial Sequence: Synthetic peptide
RTLDIHVMG

SEQ ID NO: 1375 - protein, 9 aa, Artificial Sequence
  Description of Artificial Sequence: Synthetic peptide
FTPDNYAMG

SEQ ID NO: 1376 - protein, 9 aa, Artificial Sequence
  Description of Artificial Sequence: Synthetic peptide
FTFDDYAMG

SEQ ID NO: 1377 - protein, 9 aa, Artificial Sequence
  Description of Artificial Sequence: Synthetic peptide
RTFSRYIMG

SEQ ID NO: 1378 - protein, 9 aa, Artificial Sequence
  Description of Artificial Sequence: Synthetic peptide
PTFSIYAMG

SEQ ID NO: 1379 - protein, 9 aa, Artificial Sequence
  Description of Artificial Sequence: Synthetic peptide
RTFSLNAMG

SEQ ID NO: 1380 - protein, 9 aa, Artificial Sequence
  Description of Artificial Sequence: Synthetic peptide
STFSINAMG

SEQ ID NO: 1381 - protein, 9 aa, Artificial Sequence
  Description of Artificial Sequence: Synthetic peptide
RTFSMHAMG

SEQ ID NO: 1382 - protein, 9 aa, Artificial Sequence
  Description of Artificial Sequence: Synthetic peptide
VTLDLYAMG

SEQ ID NO: 1383 - protein, 9 aa, Artificial Sequence
  Description of Artificial Sequence: Synthetic peptide
LPFTINVMG

SEQ ID NO: 1384 - protein, 9 aa, Artificial Sequence
  Description of Artificial Sequence: Synthetic peptide
RAFSNYAMG

SEQ ID NO: 1385 - protein, 9 aa, Artificial Sequence
  Description of Artificial Sequence: Synthetic peptide
FTPDDYAMG

SEQ ID NO: 1386 - protein, 9 aa, Artificial Sequence
  Description of Artificial Sequence: Synthetic peptide
FTLNYYGMG

SEQ ID NO: 1387 - protein, 9 aa, Artificial Sequence
  Description of Artificial Sequence: Synthetic peptide
LPFSTKSMG

SEQ ID NO: 1388 - protein, 9 aa, Artificial Sequence
  Description of Artificial Sequence: Synthetic peptide
RTFSINAMG

SEQ ID NO: 1389 - protein, 9 aa, Artificial Sequence
  Description of Artificial Sequence: Synthetic peptide
EEFSDHWMG

SEQ ID NO: 1390 - protein, 9 aa, Artificial Sequence
  Description of Artificial Sequence: Synthetic peptide
FTFGSYDMG

SEQ ID NO: 1391 - protein, 9 aa, Artificial Sequence
  Description of Artificial Sequence: Synthetic peptide
LPLDLYAMG

SEQ ID NO: 1392 - protein, 9 aa, Artificial Sequence
  Description of Artificial Sequence: Synthetic peptide
RTSTVNGMG

SEQ ID NO: 1393 - protein, 9 aa, Artificial Sequence
  Description of Artificial Sequence: Synthetic peptide
FSLDYYGMG

SEQ ID NO: 1394 - protein, 9 aa, Artificial Sequence
  Description of Artificial Sequence: Synthetic peptide
RPNSINWMG

SEQ ID NO: 1395 - protein, 9 aa, Artificial Sequence
  Description of Artificial Sequence: Synthetic peptide
EKFSDHWMG

SEQ ID NO: 1396 - protein, 9 aa, Artificial Sequence
  Description of Artificial Sequence: Synthetic peptide
LTVVPYAMG

SEQ ID NO: 1397 - protein, 9 aa, Artificial Sequence
  Description of Artificial Sequence: Synthetic peptide
TTFNFNVMG

SEQ ID NO: 1398 - protein, 9 aa, Artificial Sequence
  Description of Artificial Sequence: Synthetic peptide
IDVNRNAMG

SEQ ID NO: 1399 - protein, 8 aa, Artificial Sequence
  Description of Artificial Sequence: Synthetic peptide
RTFSSNMG

SEQ ID NO: 1400 - protein, 9 aa, Artificial Sequence
  Description of Artificial Sequence: Synthetic peptide
GTFSMGWIR

SEQ ID NO: 1401 - protein, 9 aa, Artificial Sequence
  Description of Artificial Sequence: Synthetic peptide
CTLDYYAMG

SEQ ID NO: 1402 - protein, 9 aa, Artificial Sequence
  Description of Artificial Sequence: Synthetic peptide
LTFSLYRMC

SEQ ID NO: 1403 - protein, 9 aa, Artificial Sequence
  Description of Artificial Sequence: Synthetic peptide
RSFSSHRMG

SEQ ID NO: 1404 - protein, 9 aa, Artificial Sequence
  Description of Artificial Sequence: Synthetic peptide
RIIVPNTMG

SEQ ID NO: 1405 - protein, 8 aa, Artificial Sequence
  Description of Artificial Sequence: Synthetic peptide
SIFIISMG

SEQ ID NO: 1406 - protein, 9 aa, Artificial Sequence
  Description of Artificial Sequence: Synthetic peptide
FSLDYYDMG

SEQ ID NO: 1407 - protein, 9 aa, Artificial Sequence
  Description of Artificial Sequence: Synthetic peptide
TSISNRVMG

SEQ ID NO: 1408 - protein, 9 aa, Artificial Sequence
  Description of Artificial Sequence: Synthetic peptide
NIDRLYAMG

SEQ ID NO: 1409 - protein, 9 aa, Artificial Sequence
  Description of Artificial Sequence: Synthetic peptide
NTFTINVMG

SEQ ID NO: 1410 - protein, 9 aa, Artificial Sequence
  Description of Artificial Sequence: Synthetic peptide
FNVNDYAMG

SEQ ID NO: 1411 - protein, 9 aa, Artificial Sequence
  Description of Artificial Sequence: Synthetic peptide
FTFDHYTMG

SEQ ID NO: 1412 - protein, 9 aa, Artificial Sequence
  Description of Artificial Sequence: Synthetic peptide
RTFGNYNMG

SEQ ID NO: 1413 - protein, 9 aa, Artificial Sequence
  Description of Artificial Sequence: Synthetic peptide
FTMSSSWMG

SEQ ID NO: 1414 - protein, 9 aa, Artificial Sequence
  Description of Artificial Sequence: Synthetic peptide
FTFSPSWMG

SEQ ID NO: 1415 - protein, 9 aa, Artificial Sequence
  Description of Artificial Sequence: Synthetic peptide
FTRDYYTMG

SEQ ID NO: 1416 - protein, 6 aa, Artificial Sequence
  Description of Artificial Sequence: Synthetic peptide
RTFTMG

SEQ ID NO: 1417 - protein, 9 aa, Artificial Sequence
  Description of Artificial Sequence: Synthetic peptide
TTLDYYAMG

SEQ ID NO: 1418 - protein, 9 aa, Artificial Sequence
  Description of Artificial Sequence: Synthetic peptide
FTFSSYWMG

SEQ ID NO: 1419 - protein, 9 aa, Artificial Sequence
  Description of Artificial Sequence: Synthetic peptide
FTLSGIWMG

SEQ ID NO: 1420 - protein, 9 aa, Artificial Sequence
  Description of Artificial Sequence: Synthetic peptide
FTFDYYAMG

SEQ ID NO: 1421 - protein, 9 aa, Artificial Sequence
  Description of Artificial Sequence: Synthetic peptide
SIASIHAMG

SEQ ID NO: 1422 - protein, 9 aa, Artificial Sequence
  Description of Artificial Sequence: Synthetic peptide
LAFNAYAMG

SEQ ID NO: 1423 - protein, 9 aa, Artificial Sequence
  Description of Artificial Sequence: Synthetic peptide
STYTTYSMG

SEQ ID NO: 1424 - protein, 9 aa, Artificial Sequence
  Description of Artificial Sequence: Synthetic peptide
LTFNDYAMG

SEQ ID NO: 1425 - protein, 9 aa, Artificial Sequence
  Description of Artificial Sequence: Synthetic peptide
ITFRFKAMG

SEQ ID NO: 1426 - protein, 9 aa, Artificial Sequence
  Description of Artificial Sequence: Synthetic peptide
STVLINAMG

SEQ ID NO: 1427 - protein, 9 aa, Artificial Sequence
  Description of Artificial Sequence: Synthetic peptide
FTFDDAAMG

SEQ ID NO: 1428 - protein, 9 aa, Artificial Sequence
  Description of Artificial Sequence: Synthetic peptide
NTGSTGYMG

SEQ ID NO: 1429 - protein, 9 aa, Artificial Sequence
  Description of Artificial Sequence: Synthetic peptide
LTFRNYAMG

SEQ ID NO: 1430 - protein, 9 aa, Artificial Sequence
  Description of Artificial Sequence: Synthetic peptide
SILSIAVMG

SEQ ID NO: 1431 - protein, 9 aa, Artificial Sequence
  Description of Artificial Sequence: Synthetic peptide
STLPYHAMG

SEQ ID NO: 1432 - protein, 9 aa, Artificial Sequence
  Description of Artificial Sequence: Synthetic peptide
TLFKINAMG

SEQ ID NO: 1433 - protein, 9 aa, Artificial Sequence
  Description of Artificial Sequence: Synthetic peptide
RTFSEVVMG

SEQ ID NO: 1434 - protein, 9 aa, Artificial Sequence
  Description of Artificial Sequence: Synthetic peptide
SIFSMNTMG

SEQ ID NO: 1435 - protein, 9 aa, Artificial Sequence
  Description of Artificial Sequence: Synthetic peptide
FTLDYYAMG

SEQ ID NO: 1436 - protein, 9 aa, Artificial Sequence
  Description of Artificial Sequence: Synthetic peptide
LTFGTYTMG

SEQ ID NO: 1437 - protein, 9 aa, Artificial Sequence
  Description of Artificial Sequence: Synthetic peptide
DTFSTSWMG

SEQ ID NO: 1438 - protein, 9 aa, Artificial Sequence
  Description of Artificial Sequence: Synthetic peptide
ITFRFKAMG

SEQ ID NO: 1439 - protein, 9 aa, Artificial Sequence
  Description of Artificial Sequence: Synthetic peptide
DTYGSYWMG

SEQ ID NO: 1440 - protein, 10 aa, Artificial Sequence
  Description of Artificial Sequence: Synthetic peptide
YTLKNYYAMG

SEQ ID NO: 1441 - protein, 9 aa, Artificial Sequence
  Description of Artificial Sequence: Synthetic peptide
FAFGDSWMG

SEQ ID NO: 1442 - protein, 9 aa, Artificial Sequence
  Description of Artificial Sequence: Synthetic peptide
DTFSANRMG

SEQ ID NO: 1443 - protein, 9 aa, Artificial Sequence
  Description of Artificial Sequence: Synthetic peptide
FTLDYYDMG

SEQ ID NO: 1444 - protein, 9 aa, Artificial Sequence
  Description of Artificial Sequence: Synthetic peptide
TFQRINHMG

SEQ ID NO: 1445 - protein, 9 aa, Artificial Sequence
  Description of Artificial Sequence: Synthetic peptide
SAFRSNAMG

SEQ ID NO: 1446 - protein, 9 aa, Artificial Sequence
  Description of Artificial Sequence: Synthetic peptide
FTLAYYAMG

SEQ ID NO: 1447 - protein, 9 aa, Artificial Sequence
  Description of Artificial Sequence: Synthetic peptide
FDFSVSWMG

SEQ ID NO: 1448 - protein, 9 aa, Artificial Sequence
  Description of Artificial Sequence: Synthetic peptide
HTFSTSWMG

SEQ ID NO: 1449 - protein, 9 aa, Artificial Sequence
  Description of Artificial Sequence: Synthetic peptide
NTFSGGFMG

SEQ ID NO: 1450 - protein, 9 aa, Artificial Sequence
  Description of Artificial Sequence: Synthetic peptide
FTFSPSWMG

SEQ ID NO: 1451 - protein, 9 aa, Artificial Sequence
  Description of Artificial Sequence: Synthetic peptide
FTFSDYWMG

SEQ ID NO: 1452 - protein, 9 aa, Artificial Sequence
  Description of Artificial Sequence: Synthetic peptide
FTFSTSWMG

SEQ ID NO: 1453 - protein, 9 aa, Artificial Sequence
  Description of Artificial Sequence: Synthetic peptide
DTYGSYWMG

SEQ ID NO: 1454 - protein, 10 aa, Artificial Sequence
  Description of Artificial Sequence: Synthetic peptide
RTFSSYAMMG

SEQ ID NO: 1455 - protein, 9 aa, Artificial Sequence
  Description of Artificial Sequence: Synthetic peptide
GTFGVYHMG

SEQ ID NO: 1456 - protein, 9 aa, Artificial Sequence
  Description of Artificial Sequence: Synthetic peptide
NMFSINAMG

SEQ ID NO: 1457 - protein, 7 aa, Artificial Sequence
  Description of Artificial Sequence: Synthetic peptide
LTFSAMG

SEQ ID NO: 1458 - protein, 9 aa, Artificial Sequence
  Description of Artificial Sequence: Synthetic peptide
RTFSMHAMG

SEQ ID NO: 1459 - protein, 9 aa, Artificial Sequence
  Description of Artificial Sequence: Synthetic peptide
FTVSNYAMG

SEQ ID NO: 1460 - protein, 9 aa, Artificial Sequence
  Description of Artificial Sequence: Synthetic peptide
STVLINAMG

SEQ ID NO: 1461 - protein, 9 aa, Artificial Sequence
  Description of Artificial Sequence: Synthetic peptide
FSFDRWAMG

SEQ ID NO: 1462 - protein, 9 aa, Artificial Sequence
  Description of Artificial Sequence: Synthetic peptide
YTYSSYVMG

SEQ ID NO: 1463 - protein, 9 aa, Artificial Sequence
  Description of Artificial Sequence: Synthetic peptide
DTYGSYWMG

SEQ ID NO: 1464 - protein, 9 aa, Artificial Sequence
  Description of Artificial Sequence: Synthetic peptide
ISINTNVMG

SEQ ID NO: 1465 - protein, 9 aa, Artificial Sequence
  Description of Artificial Sequence: Synthetic peptide
FEFENHWMG

SEQ ID NO: 1466 - protein, 9 aa, Artificial Sequence
  Description of Artificial Sequence: Synthetic peptide
FTMSSSWMG

SEQ ID NO: 1467 - protein, 8 aa, Artificial Sequence
  Description of Artificial Sequence: Synthetic peptide
NIFRSNMG

SEQ ID NO: 1468 - protein, 9 aa, Artificial Sequence
  Description of Artificial Sequence: Synthetic peptide
LTFDDHSMG

SEQ ID NO: 1469 - protein, 9 aa, Artificial Sequence
  Description of Artificial Sequence: Synthetic peptide
RAVSTYAMG

SEQ ID NO: 1470 - protein, 12 aa, Artificial Sequence
  Description of Artificial Sequence: Synthetic peptide
ISGSVFSRTPMG

SEQ ID NO: 1471 - protein, 9 aa, Artificial Sequence
  Description of Artificial Sequence: Synthetic peptide
DTYGSYWMG

SEQ ID NO: 1472 - protein, 9 aa, Artificial Sequence
  Description of Artificial Sequence: Synthetic peptide
DTYGSYWMG

SEQ ID NO: 1473 - protein, 9 aa, Artificial Sequence
  Description of Artificial Sequence: Synthetic peptide
STFSGNWMG

SEQ ID NO: 1474 - protein, 6 aa, Artificial Sequence
  Description of Artificial Sequence: Synthetic peptide
QTFNMG

SEQ ID NO: 1475 - protein, 8 aa, Artificial Sequence
  Description of Artificial Sequence: Synthetic peptide
IPSIHAMG

SEQ ID NO: 1476 - protein, 9 aa, Artificial Sequence
  Description of Artificial Sequence: Synthetic peptide
LPFSTLHMG

SEQ ID NO: 1477 - protein, 9 aa, Artificial Sequence
  Description of Artificial Sequence: Synthetic peptide
LTFSLFAMG

SEQ ID NO: 1478 - protein, 8 aa, Artificial Sequence
  Description of Artificial Sequence: Synthetic peptide
SFSNYAMG

SEQ ID NO: 1479 - protein, 9 aa, Artificial Sequence
  Description of Artificial Sequence: Synthetic peptide
FTLSDRAMG

SEQ ID NO: 1480 - protein, 9 aa, Artificial Sequence
  Description of Artificial Sequence: Synthetic peptide
GTFSSVGMG

SEQ ID NO: 1481 - protein, 10 aa, Artificial Sequence
  Description of Artificial Sequence: Synthetic peptide
FNLDDYADMG

SEQ ID NO: 1482 - protein, 9 aa, Artificial Sequence
  Description of Artificial Sequence: Synthetic peptide
ITFSNDAMG

SEQ ID NO: 1483 - protein, 9 aa, Artificial Sequence
  Description of Artificial Sequence: Synthetic peptide
STLSINAMG

SEQ ID NO: 1484 - protein, 9 aa, Artificial Sequence
  Description of Artificial Sequence: Synthetic peptide
HTFSGYAMG

SEQ ID NO: 1485 - protein, 9 aa, Artificial Sequence
  Description of Artificial Sequence: Synthetic peptide
FAFGDSWMG

SEQ ID NO: 1486 - protein, 9 aa, Artificial Sequence
  Description of Artificial Sequence: Synthetic peptide
GTFSTYWMG

SEQ ID NO: 1487 - protein, 9 aa, Artificial Sequence
  Description of Artificial Sequence: Synthetic peptide
LAFDFDGMG

SEQ ID NO: 1488 - protein, 9 aa, Artificial Sequence
  Description of Artificial Sequence: Synthetic peptide
FTFDRSWMG

SEQ ID NO: 1489 - protein, 7 aa, Artificial Sequence
  Description of Artificial Sequence: Synthetic peptide
RTYDAMG

SEQ ID NO: 1490 - protein, 9 aa, Artificial Sequence
  Description of Artificial Sequence: Synthetic peptide
SISSIDYMG

SEQ ID NO: 1491 - protein, 9 aa, Artificial Sequence
  Description of Artificial Sequence: Synthetic peptide
GTFSFYNMG

SEQ ID NO: 1492 - protein, 9 aa, Artificial Sequence
  Description of Artificial Sequence: Synthetic peptide
FIGNYHAMG

SEQ ID NO: 1493 - protein, 9 aa, Artificial Sequence
  Description of Artificial Sequence: Synthetic peptide
SSLDAYGMG

SEQ ID NO: 1494 - protein, 9 aa, Artificial Sequence
  Description of Artificial Sequence: Synthetic peptide
SIASIHAMG

SEQ ID NO: 1495 - protein, 9 aa, Artificial Sequence
  Description of Artificial Sequence: Synthetic peptide
FTPDDYAMG

SEQ ID NO: 1496 - protein, 9 aa, Artificial Sequence
  Description of Artificial Sequence: Synthetic peptide
GTFSVFAMG

SEQ ID NO: 1497 - protein, 9 aa, Artificial Sequence
  Description of Artificial Sequence: Synthetic peptide
PISGINRMG

SEQ ID NO: 1498 - protein, 9 aa, Artificial Sequence
  Description of Artificial Sequence: Synthetic peptide
TSIMVGAMG

SEQ ID NO: 1499 - protein, 9 aa, Artificial Sequence
  Description of Artificial Sequence: Synthetic peptide
RTFSTHWMG

SEQ ID NO: 1500 - protein, 8 aa, Artificial Sequence
  Description of Artificial Sequence: Synthetic peptide
TIFASAMG

SEQ ID NO: 1501 - protein, 9 aa, Artificial Sequence
  Description of Artificial Sequence: Synthetic peptide
FPFSIWPMG

SEQ ID NO: 1502 - protein, 9 aa, Artificial Sequence
  Description of Artificial Sequence: Synthetic peptide
RTFGNYAMG

SEQ ID NO: 1503 - protein, 10 aa, Artificial Sequence
  Description of Artificial Sequence: Synthetic peptide
FLFDSYASMG

SEQ ID NO: 1504 - protein, 9 aa, Artificial Sequence
  Description of Artificial Sequence: Synthetic peptide
LPFSTKSMG

SEQ ID NO: 1505 - protein, 9 aa, Artificial Sequence
  Description of Artificial Sequence: Synthetic peptide
NIFRIETMG

SEQ ID NO: 1506 - protein, 9 aa, Artificial Sequence
  Description of Artificial Sequence: Synthetic peptide
IPSSIRAMG

SEQ ID NO: 1507 - protein, 9 aa, Artificial Sequence
  Description of Artificial Sequence: Synthetic peptide
FTLSGNWMG

SEQ ID NO: 1508 - protein, 9 aa, Artificial Sequence
  Description of Artificial Sequence: Synthetic peptide
FTFSSLAMG

SEQ ID NO: 1509 - protein, 8 aa, Artificial Sequence
  Description of Artificial Sequence: Synthetic peptide
TFGHYAMG

SEQ ID NO: 1510 - protein, 9 aa, Artificial Sequence
  Description of Artificial Sequence: Synthetic peptide
IPFRSRTMG

SEQ ID NO: 1511 - protein, 9 aa, Artificial Sequence
  Description of Artificial Sequence: Synthetic peptide
GTFSTSWMG

SEQ ID NO: 1512 - protein, 9 aa, Artificial Sequence
  Description of Artificial Sequence: Synthetic peptide
GTFSLFAMG

SEQ ID NO: 1513 - protein, 9 aa, Artificial Sequence
  Description of Artificial Sequence: Synthetic peptide
SSFSAYAMG

SEQ ID NO: 1514 - protein, 9 aa, Artificial Sequence
  Description of Artificial Sequence: Synthetic peptide
RTSSPIAMG

SEQ ID NO: 1515 - protein, 9 aa, Artificial Sequence
  Description of Artificial Sequence: Synthetic peptide
LTFNQYTMG

SEQ ID NO: 1516 - protein, 7 aa, Artificial Sequence
  Description of Artificial Sequence: Synthetic peptide
PTFSSMG

SEQ ID NO: 1517 - protein, 9 aa, Artificial Sequence
  Description of Artificial Sequence: Synthetic peptide
IPSTLRAMG

SEQ ID NO: 1518 - protein, 10 aa, Artificial Sequence
  Description of Artificial Sequence: Synthetic peptide
GVGFSVTNMG

SEQ ID NO: 1519 - protein, 9 aa, Artificial Sequence
  Description of Artificial Sequence: Synthetic peptide
GTFGSYGMG

SEQ ID NO: 1520 - protein, 9 aa, Artificial Sequence
  Description of Artificial Sequence: Synthetic peptide
GTFSTYAMG

SEQ ID NO: 1521 - protein, 9 aa, Artificial Sequence
  Description of Artificial Sequence: Synthetic peptide
PIYAVNRMG

SEQ ID NO: 1522 - protein, 9 aa, Artificial Sequence
  Description of Artificial Sequence: Synthetic peptide
FTFSNYWMG

SEQ ID NO: 1523 - protein, 9 aa, Artificial Sequence
  Description of Artificial Sequence: Synthetic peptide
GTFSAYHMG

SEQ ID NO: 1524 - protein, 13 aa, Artificial Sequence
  Description of Artificial Sequence: Synthetic peptide
AAISWDGGATAYA

SEQ ID NO: 1525 - protein, 12 aa, Artificial Sequence
  Description of Artificial Sequence: Synthetic peptide
AIKFSGGTTDYA

SEQ ID NO: 1526 - protein, 13 aa, Artificial Sequence
  Description of Artificial Sequence: Synthetic peptide
AGISWSGDSTLYA

SEQ ID NO: 1527 - protein, 13 aa, Artificial Sequence
  Description of Artificial Sequence: Synthetic peptide
AVITCSGGSTDYA

SEQ ID NO: 1528 - protein, 18 aa, Artificial Sequence
  Description of Artificial Sequence: Synthetic peptide
AEITEGGISPSGDNIYYA

SEQ ID NO: 1529 - protein, 12 aa, Artificial Sequence
  Description of Artificial Sequence: Synthetic peptide
AAINNFGTTKYA

SEQ ID NO: 1530 - protein, 12 aa, Artificial Sequence
  Description of Artificial Sequence: Synthetic peptide
AAIHSGGSTNYA

SEQ ID NO: 1531 - protein, 13 aa, Artificial Sequence
  Description of Artificial Sequence: Synthetic peptide
SSIHWGGRGTNYA

SEQ ID NO: 1532 - protein, 13 aa, Artificial Sequence
  Description of Artificial Sequence: Synthetic peptide
AHIPRSTYSPYYA

SEQ ID NO: 1533 - protein, 12 aa, Artificial Sequence
  Description of Artificial Sequence: Synthetic peptide
AAISSYSHTAYA

SEQ ID NO: 1534 - protein, 12 aa, Artificial Sequence
  Description of Artificial Sequence: Synthetic peptide
ASISSGGGINYA

SEQ ID NO: 1535 - protein, 12 aa, Artificial Sequence
  Description of Artificial Sequence: Synthetic peptide
AINRSTGSTSYA

SEQ ID NO: 1536 - protein, 12 aa, Artificial Sequence
  Description of Artificial Sequence: Synthetic peptide
AAIRSSGGLFYA

SEQ ID NO: 1537 - protein, 13 aa, Artificial Sequence
  Description of Artificial Sequence: Synthetic peptide
SAIRWNGGNTAYA

SEQ ID NO: 1538 - protein, 12 aa, Artificial Sequence
  Description of Artificial Sequence: Synthetic peptide
ATIRWTNSTDYA

SEQ ID NO: 1539 - protein, 12 aa, Artificial Sequence
  Description of Artificial Sequence: Synthetic peptide
AAIHSGGATVYA

SEQ ID NO: 1540 - protein, 13 aa, Artificial Sequence
  Description of Artificial Sequence: Synthetic peptide
AGIRWSDVYTQYA

SEQ ID NO: 1541 - protein, 13 aa, Artificial Sequence
  Description of Artificial Sequence: Synthetic peptide
AAIHWSGGSTIYA

SEQ ID NO: 1542 - protein, 13 aa, Artificial Sequence
  Description of Artificial Sequence: Synthetic peptide
ASINWSGGSTYYA

SEQ ID NO: 1543 - protein, 12 aa, Artificial Sequence
  Description of Artificial Sequence: Synthetic peptide
AAISPSAFTEYA

SEQ ID NO: 1544 - protein, 12 aa, Artificial Sequence
  Description of Artificial Sequence: Synthetic peptide
AHISTGGATNYA

SEQ ID NO: 1545 - protein, 13 aa, Artificial Sequence
  Description of Artificial Sequence: Synthetic peptide
AAINWSDSRTDYA

SEQ ID NO: 1546 - protein, 13 aa, Artificial Sequence
  Description of Artificial Sequence: Synthetic peptide
AAISWSGESTLYA

SEQ ID NO: 1547 - protein, 12 aa, Artificial Sequence
  Description of Artificial Sequence: Synthetic peptide
AAISSYSHTAYA

SEQ ID NO: 1548 - protein, 13 aa, Artificial Sequence
  Description of Artificial Sequence: Synthetic peptide
AAIHWSGDSTLYA

SEQ ID NO: 1549 - protein, 12 aa, Artificial Sequence
  Description of Artificial Sequence: Synthetic peptide
ARIYTGGDTIYA

SEQ ID NO: 1550 - protein, 12 aa, Artificial Sequence
  Description of Artificial Sequence: Synthetic peptide
ATITPGGNTNYA

SEQ ID NO: 1551 - protein, 12 aa, Artificial Sequence
  Description of Artificial Sequence: Synthetic peptide
AEITAGGSTYYA

SEQ ID NO: 1552 - protein, 12 aa, Artificial Sequence
  Description of Artificial Sequence: Synthetic peptide
ASVLRGGYTWYA

SEQ ID NO: 1553 - protein, 13 aa, Artificial Sequence
  Description of Artificial Sequence: Synthetic peptide
AGIRWTDAYTEYA

SEQ ID NO: 1554 - protein, 13 aa, Artificial Sequence
  Description of Artificial Sequence: Synthetic peptide
AVINWTGESTLYA

SEQ ID NO: 1555 - protein, 15 aa, Artificial Sequence
  Description of Artificial Sequence: Synthetic peptide
AALGWSGVTTYHYYA

SEQ ID NO: 1556 - protein, 13 aa, Artificial Sequence
  Description of Artificial Sequence: Synthetic peptide
ATIMWSGNTTYYA

SEQ ID NO: 1557 - protein, 14 aa, Artificial Sequence
  Description of Artificial Sequence: Synthetic peptide
AAISWSGGDNTYYA

SEQ ID NO: 1558 - protein, 13 aa, Artificial Sequence
  Description of Artificial Sequence: Synthetic peptide
AGISWNGGSTNYA

SEQ ID NO: 1559 - protein, 12 aa, Artificial Sequence
  Description of Artificial Sequence: Synthetic peptide
AAISCGGGSTYA

SEQ ID NO: 1560 - protein, 13 aa, Artificial Sequence
  Description of Artificial Sequence: Synthetic peptide
GGISRSGATTNYA

SEQ ID NO: 1561 - protein, 12 aa, Artificial Sequence
  Description of Artificial Sequence: Synthetic peptide
ASISSQGRTNYA

SEQ ID NO: 1562 - protein, 13 aa, Artificial Sequence
  Description of Artificial Sequence: Synthetic peptide
AGIRWTDAYTEYA

SEQ ID NO: 1563 - protein, 13 aa, Artificial Sequence
  Description of Artificial Sequence: Synthetic peptide
AAIHWSGLTTFYA

SEQ ID NO: 1564 - protein, 20 aa, Artificial Sequence
  Description of Artificial Sequence: Synthetic peptide
AWINNRGTTDYADSGSTYYA

SEQ ID NO: 1565 - protein, 16 aa, Artificial Sequence
  Description of Artificial Sequence: Synthetic peptide
ASIGYSGRSNSYNYYA

SEQ ID NO: 1566 - protein, 12 aa, Artificial Sequence
  Description of Artificial Sequence: Synthetic peptide
AAITSGGAPHYA

SEQ ID NO: 1567 - protein, 12 aa, Artificial Sequence
  Description of Artificial Sequence: Synthetic peptide
AAIHWSGLTSYA

SEQ ID NO: 1568 - protein, 13 aa, Artificial Sequence
  Description of Artificial Sequence: Synthetic peptide
AAISWSGESTQYA

SEQ ID NO: 1569 - protein, 15 aa, Artificial Sequence
  Description of Artificial Sequence: Synthetic peptide
AAIHWSGDSTHRNYA

SEQ ID NO: 1570 - protein, 13 aa, Artificial Sequence
  Description of Artificial Sequence: Synthetic peptide
TAINWSGARTAYA

SEQ ID NO: 1571 - protein, 13 aa, Artificial Sequence
  Description of Artificial Sequence: Synthetic peptide
AGIRWSDAYTEYA

SEQ ID NO: 1572 - protein, 13 aa, Artificial Sequence
  Description of Artificial Sequence: Synthetic peptide
ASISQSGAATAYA

SEQ ID NO: 1573 - protein, 12 aa, Artificial Sequence
  Description of Artificial Sequence: Synthetic peptide
AAITSGGTPHYA

SEQ ID NO: 1574 - protein, 12 aa, Artificial Sequence
  Description of Artificial Sequence: Synthetic peptide
ATITPGGNTNYA

SEQ ID NO: 1575 - protein, 13 aa, Artificial Sequence
  Description of Artificial Sequence: Synthetic peptide
ATITFSGARTAYA

SEQ ID NO: 1576 - protein, 12 aa, Artificial Sequence
  Description of Artificial Sequence: Synthetic peptide
AAIRRSAVTNYA

SEQ ID NO: 1577 - protein, 13 aa, Artificial Sequence
  Description of Artificial Sequence: Synthetic peptide
AVISWTGESTLYA

SEQ ID NO: 1578 - protein, 13 aa, Artificial Sequence
  Description of Artificial Sequence: Synthetic peptide
AAITWSGGWRYYA

SEQ ID NO: 1579 - protein, 12 aa, Artificial Sequence
  Description of Artificial Sequence: Synthetic peptide
ARIFGGDRTLYA

SEQ ID NO: 1580 - protein, 10 aa, Artificial Sequence
  Description of Artificial Sequence: Synthetic peptide
GCIGWITYYA

SEQ ID NO: 1581 - protein, 13 aa, Artificial Sequence
  Description of Artificial Sequence: Synthetic peptide
AGIRWTDAYTEYA

SEQ ID NO: 1582 - protein, 13 aa, Artificial Sequence
  Description of Artificial Sequence: Synthetic peptide
SCISNIDGSTYYA

SEQ ID NO: 1583 - protein, 13 aa, Artificial Sequence
  Description of Artificial Sequence: Synthetic peptide
AAIMWSGSHRNYA

SEQ ID NO: 1584 - protein, 12 aa, Artificial Sequence
  Description of Artificial Sequence: Synthetic peptide
TGISPSAFTEYA

SEQ ID NO: 1585 - protein, 13 aa, Artificial Sequence
  Description of Artificial Sequence: Synthetic peptide
TGINWSGGSTTYA

SEQ ID NO: 1586 - protein, 13 aa, Artificial Sequence
  Description of Artificial Sequence: Synthetic peptide
AALGWSGGSTDYA

SEQ ID NO: 1587 - protein, 12 aa, Artificial Sequence
  Description of Artificial Sequence: Synthetic peptide
ARIYTGGDTLYA

SEQ ID NO: 1588 - protein, 12 aa, Artificial Sequence
  Description of Artificial Sequence: Synthetic peptide
AAIDSDGSTDYA

SEQ ID NO: 1589 - protein, 13 aa, Artificial Sequence
  Description of Artificial Sequence: Synthetic peptide
AAINWNGGTTLYA

SEQ ID NO: 1590 - protein, 13 aa, Artificial Sequence
  Description of Artificial Sequence: Synthetic peptide
AGITSSVGVTNYA

SEQ ID NO: 1591 - protein, 13 aa, Artificial Sequence
  Description of Artificial Sequence: Synthetic peptide
AAISGSENVTSYA

SEQ ID NO: 1592 - protein, 12 aa, Artificial Sequence
  Description of Artificial Sequence: Synthetic peptide
ATINSLGGTSYA

SEQ ID NO: 1593 - protein, 11 aa, Artificial Sequence
  Description of Artificial Sequence: Synthetic peptide
TVISGVGTSYA

SEQ ID NO: 1594 - protein, 12 aa, Artificial Sequence
  Description of Artificial Sequence: Synthetic peptide
ATINEYGGRNYA

SEQ ID NO: 1595 - protein, 13 aa, Artificial Sequence
  Description of Artificial Sequence: Synthetic peptide
AAISRSGSLTSYA

SEQ ID NO: 1596 - protein, 12 aa, Artificial Sequence
  Description of Artificial Sequence: Synthetic peptide
ASTNSAGSTNYA

SEQ ID NO: 1597 - protein, 13 aa, Artificial Sequence
  Description of Artificial Sequence: Synthetic peptide
AAISWSGGSTAYA

SEQ ID NO: 1598 - protein, 12 aa, Artificial Sequence
  Description of Artificial Sequence: Synthetic peptide
ATINWSGVTAYA

SEQ ID NO: 1599 - protein, 12 aa, Artificial Sequence
  Description of Artificial Sequence: Synthetic peptide
AIITTGGRTTYA

SEQ ID NO: 1600 - protein, 12 aa, Artificial Sequence
  Description of Artificial Sequence: Synthetic peptide
SAIDSEGRTSYA

SEQ ID NO: 1601 - protein, 13 aa, Artificial Sequence
  Description of Artificial Sequence: Synthetic peptide
AAISRSGGFGSYA

SEQ ID NO: 1602 - protein, 13 aa, Artificial Sequence
  Description of Artificial Sequence: Synthetic peptide
ATIGWSGANTYYA

SEQ ID NO: 1603 - protein, 13 aa, Artificial Sequence
  Description of Artificial Sequence: Synthetic peptide
AAISGSENVTSYA

SEQ ID NO: 1604 - protein, 13 aa, Artificial Sequence
  Description of Artificial Sequence: Synthetic peptide
AHIPRSTYSPYYA

SEQ ID NO: 1605 - protein, 13 aa, Artificial Sequence
  Description of Artificial Sequence: Synthetic peptide
AAVSWDGRNTYYA

SEQ ID NO: 1606 - protein, 13 aa, Artificial Sequence
  Description of Artificial Sequence: Synthetic peptide
AAVRWSDDYTYYA

SEQ ID NO: 1607 - protein, 13 aa, Artificial Sequence
  Description of Artificial Sequence: Synthetic peptide
AHISWSGGSTYYA

SEQ ID NO: 1608 - protein, 12 aa, Artificial Sequence
  Description of Artificial Sequence: Synthetic peptide
AGVINDGSTVYA

SEQ ID NO: 1609 - protein, 13 aa, Artificial Sequence
  Description of Artificial Sequence: Synthetic peptide
AGMMWSGGTTTYA

SEQ ID NO: 1610 - protein, 13 aa, Artificial Sequence
  Description of Artificial Sequence: Synthetic peptide
AAISPSAVTTYYA

SEQ ID NO: 1611 - protein, 13 aa, Artificial Sequence
  Description of Artificial Sequence: Synthetic peptide
AAITWNGASTSYA

SEQ ID NO: 1612 - protein, 16 aa, Artificial Sequence
  Description of Artificial Sequence: Synthetic peptide
AAITSSGSNIDYTYYA

SEQ ID NO: 1613 - protein, 12 aa, Artificial Sequence
  Description of Artificial Sequence: Synthetic peptide
ATIHSSGSTSYA

SEQ ID NO: 1614 - protein, 13 aa, Artificial Sequence
  Description of Artificial Sequence: Synthetic peptide
ALINRSGGGINYA

SEQ ID NO: 1615 - protein, 13 aa, Artificial Sequence
  Description of Artificial Sequence: Synthetic peptide
AAINWSGDNTHYA

SEQ ID NO: 1616 - protein, 12 aa, Artificial Sequence
  Description of Artificial Sequence: Synthetic peptide
AAISRFGSTYYA

SEQ ID NO: 1617 - protein, 12 aa, Artificial Sequence
  Description of Artificial Sequence: Synthetic peptide
ATINTGGGTNYA

SEQ ID NO: 1618 - protein, 12 aa, Artificial Sequence
  Description of Artificial Sequence: Synthetic peptide
ASISRSGTTYYA

SEQ ID NO: 1619 - protein, 12 aa, Artificial Sequence
  Description of Artificial Sequence: Synthetic peptide
ATITSDDRTNYA

SEQ ID NO: 1620 - protein, 13 aa, Artificial Sequence
  Description of Artificial Sequence: Synthetic peptide
AAIIWTGESTLDA

SEQ ID NO: 1621 - protein, 12 aa, Artificial Sequence
  Description of Artificial Sequence: Synthetic peptide
ATINWSGVTAYA

SEQ ID NO: 1622 - protein, 13 aa, Artificial Sequence
  Description of Artificial Sequence: Synthetic peptide
ASITWSSANTYYA

SEQ ID NO: 1623 - protein, 13 aa, Artificial Sequence
  Description of Artificial Sequence: Synthetic peptide
ALISWSGGSTYYA

SEQ ID NO: 1624 - protein, 12 aa, Artificial Sequence
  Description of Artificial Sequence: Synthetic peptide
ATINTGGQPNYA

SEQ ID NO: 1625 - protein, 13 aa, Artificial Sequence
  Description of Artificial Sequence: Synthetic peptide
AHISWSSKSTYYA

SEQ ID NO: 1626 - protein, 13 aa, Artificial Sequence
  Description of Artificial Sequence: Synthetic peptide
AAISMSGDDTIYA

SEQ ID NO: 1627 - protein, 13 aa, Artificial Sequence
  Description of Artificial Sequence: Synthetic peptide
TAITWSGDSTNYA

SEQ ID NO: 1628 - protein, 12 aa, Artificial Sequence
  Description of Artificial Sequence: Synthetic peptide
ATINSLGGTNYA

SEQ ID NO: 1629 - protein, 12 aa, Artificial Sequence
  Description of Artificial Sequence: Synthetic peptide
AVISSLSSKSYA

SEQ ID NO: 1630 - protein, 13 aa, Artificial Sequence
  Description of Artificial Sequence: Synthetic peptide
AAISWSGGSTAYA

SEQ ID NO: 1631 - protein, 13 aa, Artificial Sequence
  Description of Artificial Sequence: Synthetic peptide
ARVWWNGGSAYYA

SEQ ID NO: 1632 - protein, 12 aa, Artificial Sequence
  Description of Artificial Sequence: Synthetic peptide
ASINEYGGRNYA

SEQ ID NO: 1633 - protein, 12 aa, Artificial Sequence
  Description of Artificial Sequence: Synthetic peptide
AVITSGGSTNYA

SEQ ID NO: 1634 - protein, 13 aa, Artificial Sequence
  Description of Artificial Sequence: Synthetic peptide
ASVNWDASQINYA

SEQ ID NO: 1635 - protein, 13 aa, Artificial Sequence
  Description of Artificial Sequence: Synthetic peptide
GRITWTDGSTYYA

SEQ ID NO: 1636 - protein, 13 aa, Artificial Sequence
  Description of Artificial Sequence: Synthetic peptide
TLISWSSGRTSYA

SEQ ID NO: 1637 - protein, 12 aa, Artificial Sequence
  Description of Artificial Sequence: Synthetic peptide
ALIRRDGSTIYA

SEQ ID NO: 1638 - protein, 12 aa, Artificial Sequence
  Description of Artificial Sequence: Synthetic peptide
ASITYGGNINYA

SEQ ID NO: 1639 - protein, 13 aa, Artificial Sequence
  Description of Artificial Sequence: Synthetic peptide
ASVNWSGGTTSYA

SEQ ID NO: 1640 - protein, 13 aa, Artificial Sequence
  Description of Artificial Sequence: Synthetic peptide
AAISWSPGRTDYA

SEQ ID NO: 1641 - protein, 12 aa, Artificial Sequence
  Description of Artificial Sequence: Synthetic peptide
ASLATGGNTNYA

SEQ ID NO: 1642 - protein, 12 aa, Artificial Sequence
  Description of Artificial Sequence: Synthetic peptide
AAISRFGSTYYA

SEQ ID NO: 1643 - protein, 12 aa, Artificial Sequence
  Description of Artificial Sequence: Synthetic peptide
AAITSGGSTVYA

SEQ ID NO: 1644 - protein, 12 aa, Artificial Sequence
  Description of Artificial Sequence: Synthetic peptide
AAISTGSVTIYA

SEQ ID NO: 1645 - protein, 12 aa, Artificial Sequence
  Description of Artificial Sequence: Synthetic peptide
AHITAGGLSNYA

SEQ ID NO: 1646 - protein, 12 aa, Artificial Sequence
  Description of Artificial Sequence: Synthetic peptide
ARITSGGSTGYA

SEQ ID NO: 1647 - protein, 13 aa, Artificial Sequence
  Description of Artificial Sequence: Synthetic peptide
AGITWNGDTTYYA

SEQ ID NO: 1648 - protein, 12 aa, Artificial Sequence
  Description of Artificial Sequence: Synthetic peptide
AAVPLSGNTYYA

SEQ ID NO: 1649 - protein, 13 aa, Artificial Sequence
  Description of Artificial Sequence: Synthetic peptide
AAISGSENVTSYA

SEQ ID NO: 1650 - protein, 13 aa, Artificial Sequence
  Description of Artificial Sequence: Synthetic peptide
SSIYSDGSNTYYA

SEQ ID NO: 1651 - protein, 13 aa, Artificial Sequence
  Description of Artificial Sequence: Synthetic peptide
ATISQSGAATAYA

SEQ ID NO: 1652 - protein, 13 aa, Artificial Sequence
  Description of Artificial Sequence: Synthetic peptide
AAINWSGGSTNYA

SEQ ID NO: 1653 - protein, 13 aa, Artificial Sequence
  Description of Artificial Sequence: Synthetic peptide
AVISWTGGSTYYA

SEQ ID NO: 1654 - protein, 12 aa, Artificial Sequence
  Description of Artificial Sequence: Synthetic peptide
AAIGSGGSTSYA

SEQ ID NO: 1655 - protein, 13 aa, Artificial Sequence
  Description of Artificial Sequence: Synthetic peptide
AAINWSHGVTYYA

SEQ ID NO: 1656 - protein, 12 aa, Artificial Sequence
  Description of Artificial Sequence: Synthetic peptide
ASLSIFGATGYA

SEQ ID NO: 1657 - protein, 12 aa, Artificial Sequence
  Description of Artificial Sequence: Synthetic peptide
AAISSGGSTDYA

SEQ ID NO: 1658 - protein, 13 aa, Artificial Sequence
  Description of Artificial Sequence: Synthetic peptide
AAISSSGALTSYA

SEQ ID NO: 1659 - protein, 12 aa, Artificial Sequence
  Description of Artificial Sequence: Synthetic peptide
AHITAGGLSNYA

SEQ ID NO: 1660 - protein, 12 aa, Artificial Sequence
  Description of Artificial Sequence: Synthetic peptide
AGISRSGGTYYA

SEQ ID NO: 1661 - protein, 13 aa, Artificial Sequence
  Description of Artificial Sequence: Synthetic peptide
AAIGWGGGSTRYA

SEQ ID NO: 1662 - protein, 15 aa, Artificial Sequence
  Description of Artificial Sequence: Synthetic peptide
AIITSSDTNDTTNYA

SEQ ID NO: 1663 - protein, 13 aa, Artificial Sequence
  Description of Artificial Sequence: Synthetic peptide
AAIDWSGGSTAYA

SEQ ID NO: 1664 - protein, 12 aa, Artificial Sequence
  Description of Artificial Sequence: Synthetic peptide
AVITREGSTYYA

SEQ ID NO: 1665 - protein, 12 aa, Artificial Sequence
  Description of Artificial Sequence: Synthetic peptide
AAITSGGSTDYA

SEQ ID NO: 1666 - protein, 13 aa, Artificial Sequence
  Description of Artificial Sequence: Synthetic peptide
AAISRSGGNTYYA

SEQ ID NO: 1667 - protein, 12 aa, Artificial Sequence
  Description of Artificial Sequence: Synthetic peptide
AAINSGGSTYYA

SEQ ID NO: 1668 - protein, 12 aa, Artificial Sequence
  Description of Artificial Sequence: Synthetic peptide
AAVTEGGTTSYA

SEQ ID NO: 1669 - protein, 12 aa, Artificial Sequence
  Description of Artificial Sequence: Synthetic peptide
ASVTSGGYTHYA

SEQ ID NO: 1670 - protein, 13 aa, Artificial Sequence
  Description of Artificial Sequence: Synthetic peptide
SWISSSDGSTYYA

SEQ ID NO: 1671 - protein, 12 aa, Artificial Sequence
  Description of Artificial Sequence: Synthetic peptide
AFISGNGGTSYA

SEQ ID NO: 1672 - protein, 13 aa, Artificial Sequence
  Description of Artificial Sequence: Synthetic peptide
AAVTWSGGTTNYA

SEQ ID NO: 1673 - protein, 13 aa, Artificial Sequence
  Description of Artificial Sequence: Synthetic peptide
AAISWGGGSIYYA

SEQ ID NO: 1674 - protein, 13 aa, Artificial Sequence
  Description of Artificial Sequence: Synthetic peptide
AAITWSGAITSYA

SEQ ID NO: 1675 - protein, 13 aa, Artificial Sequence
  Description of Artificial Sequence: Synthetic peptide
AAINSGGSYTYYA

SEQ ID NO: 1676 - protein, 13 aa, Artificial Sequence
  Description of Artificial Sequence: Synthetic peptide
SAINWSGGSLLYA

SEQ ID NO: 1677 - protein, 12 aa, Artificial Sequence
  Description of Artificial Sequence: Synthetic peptide
AVITSNGRPSYA

SEQ ID NO: 1678 - protein, 12 aa, Artificial Sequence
  Description of Artificial Sequence: Synthetic peptide
AIIRGDGRTSYA

SEQ ID NO: 1679 - protein, 13 aa, Artificial Sequence
  Description of Artificial Sequence: Synthetic peptide
AVINWSGGSIYYA

SEQ ID NO: 1680 - protein, 13 aa, Artificial Sequence
  Description of Artificial Sequence: Synthetic peptide
AVVNWNGSSTVYA

SEQ ID NO: 1681 - protein, 11 aa, Artificial Sequence
  Description of Artificial Sequence: Synthetic peptide
AAVRWSSTYYA

SEQ ID NO: 1682 - protein, 13 aa, Artificial Sequence
  Description of Artificial Sequence: Synthetic peptide
ASISSSGVSKHYA

SEQ ID NO: 1683 - protein, 15 aa, Artificial Sequence
  Description of Artificial Sequence: Synthetic peptide
ATIWRRGNTYYANYA

SEQ ID NO: 1684 - protein, 12 aa, Artificial Sequence
  Description of Artificial Sequence: Synthetic peptide
AAISMSGLTSYA

SEQ ID NO: 1685 - protein, 13 aa, Artificial Sequence
  Description of Artificial Sequence: Synthetic peptide
AGIIRSGGETLYA

SEQ ID NO: 1686 - protein, 13 aa, Artificial Sequence
  Description of Artificial Sequence: Synthetic peptide
AVIRWTGGSTYYA

SEQ ID NO: 1687 - protein, 12 aa, Artificial Sequence
  Description of Artificial Sequence: Synthetic peptide
AIITSGGRTNYA

SEQ ID NO: 1688 - protein, 13 aa, Artificial Sequence
  Description of Artificial Sequence: Synthetic peptide
AAITWSGDITNYA

SEQ ID NO: 1689 - protein, 13 aa, Artificial Sequence
  Description of Artificial Sequence: Synthetic peptide
AAINWSSRSTVYA

SEQ ID NO: 1690 - protein, 13 aa, Artificial Sequence
  Description of Artificial Sequence: Synthetic peptide
AGISRSGASTAYA

SEQ ID NO: 1691 - protein, 12 aa, Artificial Sequence
  Description of Artificial Sequence: Synthetic peptide
AHITAGGLSNYA

SEQ ID NO: 1692 - protein, 16 aa, Artificial Sequence
  Description of Artificial Sequence: Synthetic peptide
AAISWTGDSTYYKYYA

SEQ ID NO: 1693 - protein, 12 aa, Artificial Sequence
  Description of Artificial Sequence: Synthetic peptide
SAIDSEGTTTYA

SEQ ID NO: 1694 - protein, 12 aa, Artificial Sequence
  Description of Artificial Sequence: Synthetic peptide
AVRWSDDYTYYA

SEQ ID NO: 1695 - protein, 12 aa, Artificial Sequence
  Description of Artificial Sequence: Synthetic peptide
ASITDGGSTYYA

SEQ ID NO: 1696 - protein, 13 aa, Artificial Sequence
  Description of Artificial Sequence: Synthetic peptide
AAISWDGGATAYA

SEQ ID NO: 1697 - protein, 13 aa, Artificial Sequence
  Description of Artificial Sequence: Synthetic peptide
AATSWSGGSKYYA

SEQ ID NO: 1698 - protein, 12 aa, Artificial Sequence
  Description of Artificial Sequence: Synthetic peptide
AVISSSSSTNYA

SEQ ID NO: 1699 - protein, 13 aa, Artificial Sequence
  Description of Artificial Sequence: Synthetic peptide
AAIRWSGGITYYA

SEQ ID NO: 1700 - protein, 12 aa, Artificial Sequence
  Description of Artificial Sequence: Synthetic peptide
ASIDWSGLTSYA

SEQ ID NO: 1701 - protein, 13 aa, Artificial Sequence
  Description of Artificial Sequence: Synthetic peptide
AGIWRSGGHRDYA

SEQ ID NO: 1702 - protein, 13 aa, Artificial Sequence
  Description of Artificial Sequence: Synthetic peptide
GGISRSGVSTSYA

SEQ ID NO: 1703 - protein, 12 aa, Artificial Sequence
  Description of Artificial Sequence: Synthetic peptide
TIIDNGGPTSYA

SEQ ID NO: 1704 - protein, 12 aa, Artificial Sequence
  Description of Artificial Sequence: Synthetic peptide
CAKEDVGKPFDW

SEQ ID NO: 1705 - protein, 17 aa, Artificial Sequence
  Description of Artificial Sequence: Synthetic peptide
CASWDGLIGLDAYEYDW

SEQ ID NO: 1706 - protein, 12 aa, Artificial Sequence
  Description of Artificial Sequence: Synthetic peptide
CAAFDGYTGSDW

SEQ ID NO: 1707 - protein, 12 aa, Artificial Sequence
  Description of Artificial Sequence: Synthetic peptide
CAADDCYIGCGW

SEQ ID NO: 1708 - protein, 21 aa, Artificial Sequence
  Description of Artificial Sequence: Synthetic peptide
CAAELHSSDYTSPGAESDYGW

SEQ ID NO: 1709 - protein, 21 aa, Artificial Sequence
  Description of Artificial Sequence: Synthetic peptide
CAASASDYGLGLELFHDEYNW

SEQ ID NO: 1710 - protein, 10 aa, Artificial Sequence
  Description of Artificial Sequence: Synthetic peptide
CATVATALIW

SEQ ID NO: 1711 - protein, 18 aa, Artificial Sequence
  Description of Artificial Sequence: Synthetic peptide
CAAELHSSDYTSPGAYAW

SEQ ID NO: 1712 - protein, 10 aa, Artificial Sequence
  Description of Artificial Sequence: Synthetic peptide
CAAIGDGAVW

SEQ ID NO: 1713 - protein, 13 aa, Artificial Sequence
  Description of Artificial Sequence: Synthetic peptide
CALQPFGASNYRW

SEQ ID NO: 1714 - protein, 10 aa, Artificial Sequence
  Description of Artificial Sequence: Synthetic peptide
CAAESWGRQW

SEQ ID NO: 1715 - protein, 11 aa, Artificial Sequence
  Description of Artificial Sequence: Synthetic peptide
CATSGSGSPNW

SEQ ID NO: 1716 - protein, 12 aa, Artificial Sequence
  Description of Artificial Sequence: Synthetic peptide
CAAYLDGYSGSW

SEQ ID NO: 1717 - protein, 12 aa, Artificial Sequence
  Description of Artificial Sequence: Synthetic peptide
CAGFDGYTGSDW

SEQ ID NO: 1718 - protein, 12 aa, Artificial Sequence
  Description of Artificial Sequence: Synthetic peptide
CARGRYGIVERW

SEQ ID NO: 1719 - protein, 13 aa, Artificial Sequence
  Description of Artificial Sequence: Synthetic peptide
CAARRWIPPGPIW

SEQ ID NO: 1720 - protein, 10 aa, Artificial Sequence
  Description of Artificial Sequence: Synthetic peptide
CALDIDYRDW

SEQ ID NO: 1721 - protein, 25 aa, Artificial Sequence
  Description of Artificial Sequence: Synthetic peptide
CAADVYPQDYGLGYVEGKMYYGMDW

SEQ ID NO: 1722 - protein, 11 aa, Artificial Sequence
  Description of Artificial Sequence: Synthetic peptide
CAAYGSGEFDW

SEQ ID NO: 1723 - protein, 10 aa, Artificial Sequence
  Description of Artificial Sequence: Synthetic peptide
CAARRWGYDW

SEQ ID NO: 1724 - protein, 19 aa, Artificial Sequence
  Description of Artificial Sequence: Synthetic peptide
CATFPAIVTDSDYDLGNDW

SEQ ID NO: 1725 - protein, 19 aa, Artificial Sequence
  Description of Artificial Sequence: Synthetic peptide
CASGSDNRARELSRYEYVW

SEQ ID NO: 1726 - protein, 12 aa, Artificial Sequence
  Description of Artificial Sequence: Synthetic peptide
CAAFDGYSGSDW

SEQ ID NO: 1727 - protein, 13 aa, Artificial Sequence
  Description of Artificial Sequence: Synthetic peptide
CALQPFGASSYRW

SEQ ID NO: 1728 - protein, 12 aa, Artificial Sequence
  Description of Artificial Sequence: Synthetic peptide
CAAFDGYSGNHW

SEQ ID NO: 1729 - protein, 19 aa, Artificial Sequence
  Description of Artificial Sequence: Synthetic peptide
CAARTSYNGRYDYIDDYSW

SEQ ID NO: 1730 - protein, 18 aa, Artificial Sequence
  Description of Artificial Sequence: Synthetic peptide
CAAAAGSTWYGTLYEYDW

SEQ ID NO: 1731 - protein, 9 aa, Artificial Sequence
  Description of Artificial Sequence: Synthetic peptide
CAVDGPFGW

SEQ ID NO: 1732 - protein, 11 aa, Artificial Sequence
  Description of Artificial Sequence: Synthetic peptide
CAKDWATGLAW

SEQ ID NO: 1733 - protein, 15 aa, Artificial Sequence
  Description of Artificial Sequence: Synthetic peptide
CAADVSPSYGSRWYW

SEQ ID NO: 1734 - protein, 12 aa, Artificial Sequence
  Description of Artificial Sequence: Synthetic peptide
CAAFDGYTGNYW

SEQ ID NO: 1735 - protein, 11 aa, Artificial Sequence
  Description of Artificial Sequence: Synthetic peptide
CASDESDAANW

SEQ ID NO: 1736 - protein, 8 aa, Artificial Sequence
  Description of Artificial Sequence: Synthetic peptide
CATNDDDV

SEQ ID NO: 1737 - protein, 18 aa, Artificial Sequence
  Description of Artificial Sequence: Synthetic peptide
CAAYRIVVGGTSPGDWRW

SEQ ID NO: 1738 - protein, 12 aa, Artificial Sequence
  Description of Artificial Sequence: Synthetic peptide
CALRRRFGGQEW

SEQ ID NO: 1739 - protein, 12 aa, Artificial Sequence
  Description of Artificial Sequence: Synthetic peptide
CAADNDMGYCSW

SEQ ID NO: 1740 - protein, 18 aa, Artificial Sequence
  Description of Artificial Sequence: Synthetic peptide
CAADGVPEYSDYASGPVW

SEQ ID NO: 1741 - protein, 16 aa, Artificial Sequence
  Description of Artificial Sequence: Synthetic peptide
CAAEVRNGSDYLPIDW

SEQ ID NO: 1742 - protein, 10 aa, Artificial Sequence
  Description of Artificial Sequence: Synthetic peptide
CAVDIDYRDW

SEQ ID NO: 1743 - protein, 12 aa, Artificial Sequence
  Description of Artificial Sequence: Synthetic peptide
CAELDGYFFAHW

SEQ ID NO: 1744 - protein, 11 aa, Artificial Sequence
  Description of Artificial Sequence: Synthetic peptide
CASTDDYGVDW

SEQ ID NO: 1745 - protein, 12 aa, Artificial Sequence
  Description of Artificial Sequence: Synthetic peptide
CAIAHGSSTYNW

SEQ ID NO: 1746 - protein, 13 aa, Artificial Sequence
  Description of Artificial Sequence: Synthetic peptide
CASAYDRGIGYDW

SEQ ID NO: 1747 - protein, 18 aa, Artificial Sequence
  Description of Artificial Sequence: Synthetic peptide
CAADRAADFFAQRDEYDW

SEQ ID NO: 1748 - protein, 12 aa, Artificial Sequence
  Description of Artificial Sequence: Synthetic peptide
CAAFDGGSGTQW

SEQ ID NO: 1749 - protein, 10 aa, Artificial Sequence
  Description of Artificial Sequence: Synthetic peptide
CATVGITLNW

SEQ ID NO: 1750 - protein, 13 aa, Artificial Sequence
  Description of Artificial Sequence: Synthetic peptide
CAARSVYSYEYNW

SEQ ID NO: 1751 - protein, 10 aa, Artificial Sequence
  Description of Artificial Sequence: Synthetic peptide
CALDIDYRHW

SEQ ID NO: 1752 - protein, 16 aa, Artificial Sequence
  Description of Artificial Sequence: Synthetic peptide
CAADRTYSYSSTGYYW

SEQ ID NO: 1753 - protein, 13 aa, Artificial Sequence
  Description of Artificial Sequence: Synthetic peptide
CASAYNPGIGYDW

SEQ ID NO: 1754 - protein, 18 aa, Artificial Sequence
  Description of Artificial Sequence: Synthetic peptide
CAAAAGTTWYGTLYEYDW

SEQ ID NO: 1755 - protein, 17 aa, Artificial Sequence
  Description of Artificial Sequence: Synthetic peptide
CAALIKPSSTDRIFEEW

SEQ ID NO: 1756 - protein, 11 aa, Artificial Sequence
  Description of Artificial Sequence: Synthetic peptide
CAARRWGYHYW

SEQ ID NO: 1757 - protein, 12 aa, Artificial Sequence
  Description of Artificial Sequence: Synthetic peptide
CAAFDGYTGRDW

SEQ ID NO: 1758 - protein, 18 aa, Artificial Sequence
  Description of Artificial Sequence: Synthetic peptide
CATTFGDAGIPDQYDFGW

SEQ ID NO: 1759 - protein, 8 aa, Artificial Sequence
  Description of Artificial Sequence: Synthetic peptide
CADINGDW

SEQ ID NO: 1760 - protein, 6 aa, Artificial Sequence
  Description of Artificial Sequence: Synthetic peptide
CAPFGW

SEQ ID NO: 1761 - protein, 15 aa, Artificial Sequence
  Description of Artificial Sequence: Synthetic peptide
CAADVSPSYGGRWYW

SEQ ID NO: 1762 - protein, 19 aa, Artificial Sequence
  Description of Artificial Sequence: Synthetic peptide
CAADLLGDSDYEPSSGFGW

SEQ ID NO: 1763 - protein, 15 aa, Artificial Sequence
  Description of Artificial Sequence: Synthetic peptide
CAAIAYEEGVYRWDW

SEQ ID NO: 1764 - protein, 10 aa, Artificial Sequence
  Description of Artificial Sequence: Synthetic peptide
CAAHGWGCHW

SEQ ID NO: 1765 - protein, 18 aa, Artificial Sequence
  Description of Artificial Sequence: Synthetic peptide
CAASAIGSGALRRFEYDW

SEQ ID NO: 1766 - protein, 15 aa, Artificial Sequence
  Description of Artificial Sequence: Synthetic peptide
CAAGNGGRYGIVERW

SEQ ID NO: 1767 - protein, 18 aa, Artificial Sequence
  Description of Artificial Sequence: Synthetic peptide
CAARKIYRSLSYYGDYDW

SEQ ID NO: 1768 - protein, 15 aa, Artificial Sequence
  Description of Artificial Sequence: Synthetic peptide
CAALIDYGLGFPIEW

SEQ ID NO: 1769 - protein, 12 aa, Artificial Sequence
  Description of Artificial Sequence: Synthetic peptide
CAAFDGYSGIDW

SEQ ID NO: 1770 - protein, 10 aa, Artificial Sequence
  Description of Artificial Sequence: Synthetic peptide
CAADIFFVNW

SEQ ID NO: 1771 - protein, 20 aa, Artificial Sequence
  Description of Artificial Sequence: Synthetic peptide
CAAEPYIPVRTMRHMTFLTW

SEQ ID NO: 1772 - protein, 11 aa, Artificial Sequence
  Description of Artificial Sequence: Synthetic peptide
CARVDYYMDVW

SEQ ID NO: 1773 - protein, 15 aa, Artificial Sequence
  Description of Artificial Sequence: Synthetic peptide
CARGPDSSGYGFDYW

SEQ ID NO: 1774 - protein, 11 aa, Artificial Sequence
  Description of Artificial Sequence: Synthetic peptide
CARVDRDFDYW

SEQ ID NO: 1775 - protein, 16 aa, Artificial Sequence
  Description of Artificial Sequence: Synthetic peptide
CANLAYYDSSGYYDYW

SEQ ID NO: 1776 - protein, 11 aa, Artificial Sequence
  Description of Artificial Sequence: Synthetic peptide
CTTVDQYFDYW

SEQ ID NO: 1777 - protein, 14 aa, Artificial Sequence
  Description of Artificial Sequence: Synthetic peptide
CAREDYYDSSGYSW

SEQ ID NO: 1778 - protein, 11 aa, Artificial Sequence
  Description of Artificial Sequence: Synthetic peptide
CARADDYFDYW

SEQ ID NO: 1779 - protein, 21 aa, Artificial Sequence
  Description of Artificial Sequence: Synthetic peptide
CAGYSTFGSSSAYYYYSMDVG

SEQ ID NO: 1780 - protein, 10 aa, Artificial Sequence
  Description of Artificial Sequence: Synthetic peptide
CARWGPFDIW

SEQ ID NO: 1781 - protein, 20 aa, Artificial Sequence
  Description of Artificial Sequence: Synthetic peptide
CARDDKYYDSSGYPAYFQHW

SEQ ID NO: 1782 - protein, 8 aa, Artificial Sequence [sequence omitted]

SEQ ID NO: 1783 - protein, 11 aa, Artificial Sequence
  Description of Artificial Sequence: Synthetic peptide
CARVDDYMDVW

SEQ ID NO: 1784 - protein, 18 aa, Artificial Sequence
  Description of Artificial Sequence: Synthetic peptide
CAFLVGPQGVDHGAFDVW

SEQ ID NO: 1785 - protein, 11 aa, Artificial Sequence
  Description of Artificial Sequence: Synthetic peptide
CASDYYYMDVW

SEQ ID NO: 1786 - protein, 13 aa, Artificial Sequence
  Description of Artificial Sequence: Synthetic peptide
CAKEGRAGSLDYW

SEQ ID NO: 1787 - protein, 18 aa, Artificial Sequence
  Description of Artificial Sequence: Synthetic peptide
CATFGATVTATNDAFDIW

SEQ ID NO: 1788 - protein, 19 aa, Artificial Sequence
  Description of Artificial Sequence: Synthetic peptide
CARLATSHQDGTGYLFDYW

SEQ ID NO: 1789 - protein, 20 aa, Artificial Sequence
  Description of Artificial Sequence: Synthetic peptide
CAREGYYYDSSGYLNYFDYW

SEQ ID NO: 1790 - protein, 15 aa, Artificial Sequence
  Description of Artificial Sequence: Synthetic peptide
CAIGYYDSSGYFDYW

SEQ ID NO: 1791 - protein, 19 aa, Artificial Sequence
  Description of Artificial Sequence: Synthetic peptide
CARDRYYDTSASYFESETW

SEQ ID NO: 1792 - protein, 14 aa, Artificial Sequence
  Description of Artificial Sequence: Synthetic peptide
CARSNTGWYSFDYW

SEQ ID NO: 1793 - protein, 13 aa, Artificial Sequence
  Description of Artificial Sequence: Synthetic peptide
CVRVTSDYSMDSW

SEQ ID NO: 1794 - protein, 14 aa, Artificial Sequence
  Description of Artificial Sequence: Synthetic peptide
CVRLSSGYYDFDYW

SEQ ID NO: 1795 - protein, 23 aa, Artificial Sequence
  Description of Artificial Sequence: Synthetic peptide
CARAPFYCTTTKCQDNYYYMDVW

SEQ ID NO: 1796 - protein, 18 aa, Artificial Sequence
  Description of Artificial Sequence: Synthetic peptide
CARGGDYDFWSVDYMDVW

SEQ ID NO: 1797 - protein, 11 aa, Artificial Sequence
  Description of Artificial Sequence: Synthetic peptide
CARVTTSFDYW

SEQ ID NO: 1798 - protein, 11 aa, Artificial Sequence
  Description of Artificial Sequence: Synthetic peptide
CATDYSAFDMW

SEQ ID NO: 1799 - protein, 14 aa, Artificial Sequence
  Description of Artificial Sequence: Synthetic peptide
CARVTSSLSGMDVW

SEQ ID NO: 1800 - protein, 14 aa, Artificial Sequence
  Description of Artificial Sequence: Synthetic peptide
CAREGYYDSSGYYW

SEQ ID NO: 1801 - protein, 11 aa, Artificial Sequence
  Description of Artificial Sequence: Synthetic peptide
CARADGYFDYW

SEQ ID NO: 1802 - protein, 14 aa, Artificial Sequence
  Description of Artificial Sequence: Synthetic peptide
CATFNWNDEGFDFW

SEQ ID NO: 1803 - protein, 19 aa, Artificial Sequence
  Description of Artificial Sequence: Synthetic peptide
CATDFYGWGTRERDAFDIW

SEQ ID NO: 1804 - protein, 15 aa, Artificial Sequence
  Description of Artificial Sequence: Synthetic peptide
CASLIAAQDYYFDYW

SEQ ID NO: 1805 - protein, 14 aa, Artificial Sequence
  Description of Artificial Sequence: Synthetic peptide
CATYCSSTSCFDYW

SEQ ID NO: 1806 - protein, 14 aa, Artificial Sequence
  Description of Artificial Sequence: Synthetic peptide
CARELGYSSTVWPW

SEQ ID NO: 1807 - protein, 18 aa, Artificial Sequence
  Description of Artificial Sequence: Synthetic peptide
CASLLHTGPSGGNYFDYW

SEQ ID NO: 1808 - protein, 14 aa, Artificial Sequence
  Description of Artificial Sequence: Synthetic peptide
CARVSSGDYGMDVW

SEQ ID NO: 1809 - protein, 11 aa, Artificial Sequence
  Description of Artificial Sequence: Synthetic peptide
CAKVDSGYDYW

SEQ ID NO: 1810 - protein, 20 aa, Artificial Sequence
  Description of Artificial Sequence: Synthetic peptide
CHGLGEGDPYGDYEGYFDLW

SEQ ID NO: 1811 - protein, 15 aa, Artificial Sequence
  Description of Artificial Sequence: Synthetic peptide
CAREVLRQQVVLDYW

SEQ ID NO: 1812 - protein, 24 aa, Artificial Sequence
  Description of Artificial Sequence: Synthetic peptide
CAGLHYYYDSSGYNPTEYYGMDVW

SEQ ID NO: 1813 - protein, 15 aa, Artificial Sequence
  Description of Artificial Sequence: Synthetic peptide
CTHVQNSYYYAMDVW

SEQ ID NO: 1814 - protein, 21 aa, Artificial Sequence
  Description of Artificial Sequence: Synthetic peptide
CTTLGAVYFDSSGYHDYFDYW

SEQ ID NO: 1815 - protein, 15 aa, Artificial Sequence
  Description of Artificial Sequence: Synthetic peptide
CFGLLEVYDMTFDYW

SEQ ID NO: 1816 - protein, 16 aa, Artificial Sequence
  Description of Artificial Sequence: Synthetic peptide
CASLGYCSGGSCFDYW

SEQ ID NO: 1817 - protein, 16 aa, Artificial Sequence
  Description of Artificial Sequence: Synthetic peptide
CAALGILFGYDAFDIW

SEQ ID NO: 1818 - protein, 19 aa, Artificial Sequence
  Description of Artificial Sequence: Synthetic peptide
CAKEGYYDSTGYRTYFQQW

SEQ ID NO: 1819 - protein, 12 aa, Artificial Sequence
  Description of Artificial Sequence: Synthetic peptide
CATTGTVTLGYW

SEQ ID NO: 1820 - protein, 16 aa, Artificial Sequence [sequence omitted]

SEQ ID NO: 1821 - protein, 13 aa, Artificial Sequence
  Description of Artificial Sequence: Synthetic peptide
CARVTNYDAFDIW

SEQ ID NO: 1822 - protein, 18 aa, Artificial Sequence
  Description of Artificial Sequence: Synthetic peptide
CARDSGEHFWDSGYIDHW

SEQ ID NO: 1823 - protein, 11 aa, Artificial Sequence
  Description of Artificial Sequence: Synthetic peptide
CARVDSRFDYW

SEQ ID NO: 1824 - protein, 13 aa, Artificial Sequence
  Description of Artificial Sequence: Synthetic peptide
CARVDDFGYFDLW

SEQ ID NO: 1825 - protein, 19 aa, Artificial Sequence
  Description of Artificial Sequence: Synthetic peptide
CGRHWGIYDSSGFSSFDYW

SEQ ID NO: 1826 - protein, 11 aa, Artificial Sequence
  Description of Artificial Sequence: Synthetic peptide
CASVDGYFDYW

SEQ ID NO: 1827 - protein, 14 aa, Artificial Sequence
  Description of Artificial Sequence: Synthetic peptide
CARALGVTYQFDYW

SEQ ID NO: 1828 - protein, 14 aa, Artificial Sequence
  Description of Artificial Sequence: Synthetic peptide
CASFSGGPADFDYW

SEQ ID NO: 1829 - protein, 17 aa, Artificial Sequence
  Description of Artificial Sequence: Synthetic peptide
CLSVTGDTEDYGVFDTW

SEQ ID NO: 1830 - protein, 15 aa, Artificial Sequence
  Description of Artificial Sequence: Synthetic peptide
CAHWSWELGDWFDPW

SEQ ID NO: 1831 - protein, 18 aa, Artificial Sequence
  Description of Artificial Sequence: Synthetic peptide
CAGLLRYSGTYYDAFDVW

SEQ ID NO: 1832 - protein, 12 aa, Artificial Sequence
  Description of Artificial Sequence: Synthetic peptide
CAGLGWNYMDYW

SEQ ID NO: 1833 - protein, 13 aa, Artificial Sequence
  Description of Artificial Sequence: Synthetic peptide
CATHNSLSGFDYW

SEQ ID NO: 1834 - protein, 12 aa, Artificial Sequence
  Description of Artificial Sequence: Synthetic peptide
CWRLGNDYFDYW

SEQ ID NO: 1835 - protein, 12 aa, Artificial Sequence
  Description of Artificial Sequence: Synthetic peptide
CGGGYGYHFDYW

SEQ ID NO: 1836 - protein, 22 aa, Artificial Sequence
  Description of Artificial Sequence: Synthetic peptide
CWMYYYDSSGYYGNYYYGMDVW

SEQ ID NO: 1837 - protein, 22 aa, Artificial Sequence
  Description of Artificial Sequence: Synthetic peptide
CARGNTKYYYDSSGYSSAFDYW

SEQ ID NO: 1838 - protein, 15 aa, Artificial Sequence
  Description of Artificial Sequence: Synthetic peptide
CWIVGPGPLDGMDVW

SEQ ID NO: 1839 - protein, 16 aa, Artificial Sequence
  Description of Artificial Sequence: Synthetic peptide
CVHLASQTGAGYFDLW

SEQ ID NO: 1840 - protein, 13 aa, Artificial Sequence
  Description of Artificial Sequence: Synthetic peptide
CARYDFWSGYPYW

SEQ ID NO: 1841 - protein, 17 aa, Artificial Sequence
  Description of Artificial Sequence: Synthetic peptide
CAREILWFGEFGEPNVW

SEQ ID NO: 1842 - protein, 16 aa, Artificial Sequence
  Description of Artificial Sequence: Synthetic peptide
CARLHYYDSSGYFDYW

SEQ ID NO: 1843 - protein, 15 aa, Artificial Sequence
  Description of Artificial Sequence: Synthetic peptide
CARDSSATRTGPDYW

SEQ ID NO: 1844 - protein, 12 aa, Artificial Sequence
  Description of Artificial Sequence: Synthetic peptide
CARLGGEGFDYW

SEQ ID NO: 1845 - protein, 15 aa, Artificial Sequence
  Description of Artificial Sequence: Synthetic peptide
CARGLLWFGELFGYW

SEQ ID NO: 1846 - protein, 16 aa, Artificial Sequence
  Description of Artificial Sequence: Synthetic peptide
CVRHSGTDGDSSFDYW

SEQ ID NO: 1847 - protein, 11 aa, Artificial Sequence
  Description of Artificial Sequence: Synthetic peptide
CARFFRAHDYW

SEQ ID NO: 1848 - protein, 11 aa, Artificial Sequence
  Description of Artificial Sequence: Synthetic peptide
CARADYDFDYW

SEQ ID NO: 1849 - protein, 17 aa, Artificial Sequence
  Description of Artificial Sequence: Synthetic peptide
CAKFGRKIVGATELDYW

SEQ ID NO: 1850 - protein, 19 aa, Artificial Sequence
  Description of Artificial Sequence: Synthetic peptide
CARSPSFSQIYYYYYMDVW

SEQ ID NO: 1851 - protein, 20 aa, Artificial Sequence
  Description of Artificial Sequence: Synthetic peptide
CAVVAMRMVTTEGPDVLDVW

SEQ ID NO: 1852 - protein, 20 aa, Artificial Sequence
  Description of Artificial Sequence: Synthetic peptide
CAREGYYYDSSGYPYYFDYW

SEQ ID NO: 1853 - protein, 14 aa, Artificial Sequence
  Description of Artificial Sequence: Synthetic peptide
CARLSQGMVALDYW

SEQ ID NO: 1854 - protein, 17 aa, Artificial Sequence
  Description of Artificial Sequence: Synthetic peptide
CAKDGGYGELHYGMEVW

SEQ ID NO: 1855 - protein, 8 aa, Artificial Sequence [sequence omitted]

SEQ ID NO: 1856 - protein, 10 aa, Artificial Sequence
  Description of Artificial Sequence: Synthetic peptide
CALFGDFDYW

SEQ ID NO: 1857 - protein, 14 aa, Artificial Sequence
  Description of Artificial Sequence: Synthetic peptide
CVRLSSGYFDFDYW

SEQ ID NO: 1858 - protein, 13 aa, Artificial Sequence
  Description of Artificial Sequence: Synthetic peptide
CARFAGWDAFDIW

SEQ ID NO: 1859 - protein, 15 aa, Artificial Sequence
  Description of Artificial Sequence: Synthetic peptide
CARLSSDGYNYFDFW

SEQ ID NO: 1860 - protein, 11 aa, Artificial Sequence
  Description of Artificial Sequence: Synthetic peptide
CTTVDQYFNYW

SEQ ID NO: 1861 - protein, 16 aa, Artificial Sequence
  Description of Artificial Sequence: Synthetic peptide
CATGECDGGSCSLAYW

SEQ ID NO: 1862 - protein, 15 aa, Artificial Sequence
  Description of Artificial Sequence: Synthetic peptide
CVRFGSSWARDLDQW

SEQ ID NO: 1863 - protein, 9 aa, Artificial Sequence
  Description of Artificial Sequence: Synthetic peptide
CTETGTAAW

SEQ ID NO: 1864 - protein, 18 aa, Artificial Sequence
  Description of Artificial Sequence: Synthetic peptide
CLKVLGGDYEADNWFDYW

SEQ ID NO: 1865 - protein, 18 aa, Artificial Sequence
  Description of Artificial Sequence: Synthetic peptide
CARSLYYDRSGSYYFDYW

SEQ ID NO: 1866 - protein, 22 aa, Artificial Sequence
  Description of Artificial Sequence: Synthetic peptide
CARDIGYYDSSGYYNDGGFDYW

SEQ ID NO: 1867 - protein, 21 aa, Artificial Sequence
  Description of Artificial Sequence: Synthetic peptide
CAGHATFGGSSSSYYYGMDVW

SEQ ID NO: 1868 - protein, 12 aa, Artificial Sequence
  Description of Artificial Sequence: Synthetic peptide
CLRLSSSGFDHW

SEQ ID NO: 1869 - protein, 20 aa, Artificial Sequence
  Description of Artificial Sequence: Synthetic peptide
CAKSDGLMGELRSASAFDIW

SEQ ID NO: 1870 - protein, 11 aa, Artificial Sequence
  Description of Artificial Sequence: Synthetic peptide
CTHANDYGDYW

SEQ ID NO: 1871 - protein, 15 aa, Artificial Sequence
  Description of Artificial Sequence: Synthetic peptide
CARLLVREDWYFDLW

SEQ ID NO: 1872 - protein, 11 aa, Artificial Sequence
  Description of Artificial Sequence: Synthetic peptide
CAYNNSSGEYW

SEQ ID NO: 1873 - protein, 14 aa, Artificial Sequence
  Description of Artificial Sequence: Synthetic peptide
CAGDYNFWSGFDHW

SEQ ID NO: 1874 - protein, 14 aa, Artificial Sequence
  Description of Artificial Sequence: Synthetic peptide
CAKKLGGYYAFDIW

SEQ ID NO: 1875 - protein, 11 aa, Artificial Sequence [sequence omitted]

SEQ ID NO: 1876 - protein, 12 aa, Artificial Sequence
  Description of Artificial Sequence: Synthetic peptide
CAIEIVVGGIYW

SEQ ID NO: 1877 - protein, 11 aa, Artificial Sequence
  Description of Artificial Sequence: Synthetic peptide
CATDLYYMDVW

SEQ ID NO: 1878 - protein, 14 aa, Artificial Sequence
  Description of Artificial Sequence: Synthetic peptide
CTTFNWNDEGFDYW

SEQ ID NO: 1879 - protein, 20 aa, Artificial Sequence
  Description of Artificial Sequence: Synthetic peptide
CARERYWNPLPYYYYGMDVW

SEQ ID NO: 1880 - protein, 24 aa, Artificial Sequence
  Description of Artificial Sequence: Synthetic peptide
CARGPFYMYCSGTKCYSTNWFDPW

SEQ ID NO: 1881 - protein, 17 aa, Artificial Sequence
  Description of Artificial Sequence: Synthetic peptide
CARGEIDILTGYWYDYW

SEQ ID NO: 1882 - protein, 21 aa, Artificial Sequence
  Description of Artificial Sequence: Synthetic peptide
CTTLLYYYDSSGYSFDAFDIW

SEQ ID NO: 1883 - protein, 21 aa, Artificial Sequence
  Description of Artificial Sequence: Synthetic peptide
CTALLYYFDNSGYNFDPFDIW

SEQ ID NO: 1884 - protein, 117 aa, Artificial Sequence
  Description of Artificial Sequence: Synthetic polypeptide
EVQLVESGGGLVQPGGSLRLSCAASGGTFSSIGMGWFRQAPGKEREFVAAISWDGGATAYADSVKGRFTISADNSKNTAYLQMNSLKPEDTAVYYCAKEDVGKPFDWGQGTLVTVSS

SEQ ID NO: 1885 - protein, 121 aa, Artificial Sequence
  Description of Artificial Sequence: Synthetic polypeptide
EVQLVESGGGLVQPGGSLRLSCAASGLRFDDYAMGWFRQAPGKERELVAIKFSGGTTDYADSVKGRFTISADNSKNTAYLQMNSLKPEDTAVYYCASWDGLIGLDAYEYDWGQGTLVTVSS

SEQ ID NO: 1886 - protein, 117 aa, Artificial Sequence
  Description of Artificial Sequence: Synthetic polypeptide
EVQLVESGGGLVQPGGSLRLSCAASGSIFSIDVMGWFRQAPGKEREFVAGISWSGDSTLYADSVKGRFTISADNSKNTAYLQMNSLKPEDTAVYYCAAFDGYTGSDWGQGTLVTVSS

SEQ ID NO: 1887 - protein, 117 aa, Artificial Sequence
  Description of Artificial Sequence: Synthetic polypeptide
EVQLVESGGGLVQPGGSLRLSCAASGFTLADYAMGWFRQAPGKEREFVAVITCSGGSTDYADSVKGRFTISADNSKNTAYLQMNSLKPEDTAVYYCAADDCYIGCGWGQGTLVTVSS

SEQ ID NO: 1888 - protein, 131 aa, Artificial Sequence
  Description of Artificial Sequence: Synthetic polypeptide
EVQLVESGGGLVQPGGSLRLSCAASGRTFSSIAMGWFRQAPGKERELVAEITEGGISPSGDNIYYADSVKGRFTISADNSKNTAYLQMNSLKPEDTAVYYCAAELHSSDYTSPGAESDYGWGQGTLVTVSS

SEQ ID NO: 1889 - protein, 126 aa, Artificial Sequence
  Description of Artificial Sequence: Synthetic polypeptide
EVQLVESGGGLVQPGGSLRLSCAASGPTFSSYAMMGWFRQAPGKEREWVAAINNFGTTKYADSVKGRFTISADNSKNTAYLQMNSLKPEDTAVYYCAASASDYGLGLELFHDEYNWGQGTLVTVSS

SEQ ID NO: 1890 - protein, 111 aa, Artificial Sequence
  Description of Artificial Sequence: Synthetic polypeptide
EVQLVESGGGLVQPGGSLRLSCAASGSTGYMGWFRQAPGKEREFVAAIHSGGSTNYADSVKGRFTISADNSKNTAYLQMNSLKPEDTAVYYCATVATALIWGQGTLVTVSS

SEQ ID NO: 1891 - protein, 123 aa, Artificial Sequence
  Description of Artificial Sequence: Synthetic polypeptide
EVQLVESGGGLVQPGGSLRLSCAASGRPFSEYTMGWFRQAPGKEREFVSSIHWGGRGTNYADSVKGRFTISADNSKNTAYLQMNSLKPEDTAVYYCAAELHSSDYTSPGAYAWGQGTLVTVSS

SEQ ID NO: 1892 - protein, 115 aa, Artificial Sequence
  Description of Artificial Sequence: Synthetic polypeptide
EVQLVESGGGLVQPGGSLRLSCAASGLTLSTYGMGWFRQAPGKEREFVAHIPRSTYSPYYADSVKGRFTISADNSKNTAYLQMNSLKPEDTAVYYCAAIGDGAVWGQGTLVTVSS

SEQ ID NO: 1893 - protein, 117 aa, Artificial Sequence
  Description of Artificial Sequence: Synthetic polypeptide
EVQLVESGGGLVQPGGSLRLSCAASGFTFNNHNMGWFRQAPGKEREFVAAISSYSHTAYADSVKGRFTISADNSKNTAYLQMNSLKPEDTAVYYCALQPFGASNYRWGQGTLVTVSS

SEQ ID NO: 1894 - protein, 112 aa, Artificial Sequence
  Description of Artificial Sequence: Synthetic polypeptide
EVQLVESGGGLVQPGGSLRLSCAASGGIYRVMGWFRQAPGKERELVASISSGGGINYADSVKGRFTISADNSKNTAYLQMNSLKPEDTAVYYCAAESWGRQWGQGTLVTVSS

SEQ ID NO: 1895 - protein, 115 aa, Artificial Sequence
  Description of Artificial Sequence: Synthetic polypeptide
EVQLVESGGGLVQPGGSLRLSCAASGYTDSNLWMGWFRQAPGKEREFVAINRSTGSTSYADSVKGRFTISADNSKNTAYLQMNSLKPEDTAVYYCATSGSGSPNWGQGTLVTVSS

SEQ ID NO: 1896 - protein, 116 aa, Artificial Sequence
  Description of Artificial Sequence: Synthetic polypeptide
EVQLVESGGGLVQPGGSLRLSCAASGFTFDYYTMGWFRQAPGKEREFVAAIRSSGGLFYADSVKGRFTISADNSKNTAYLQMNSLKPEDTAVYYCAAYLDGYSGSWGQGTLVTVSS

SEQ ID NO: 1897 - protein, 117 aa, Artificial Sequence
  Description of Artificial Sequence: Synthetic polypeptide
EVQLVESGGGLVQPGGSLRLSCAASGGIFSINVMGWFRQAPGKEREWVSAIRWNGGNTAYADSVKGRFTITADNSKNTAYLQMNSLKPEDTAVYYCAGFDGYTGSDWGQGTLVTVSS

SEQ ID NO: 1898 - protein, 116 aa, Artificial Sequence
  Description of Artificial Sequence: Synthetic polypeptide
EVQLVESGGGLVQPGGSLRLSCAASGFTFDGAAMGWFRQAPGKEREFVATIRWTNSTDYADSVKGRFTISADNSKNTAYLQMNSLKPEDTAVYYCARGRYGIVERWGQGTLVTVSS

SEQ ID NO: 1899 - protein, 117 aa, Artificial Sequence
  Description of Artificial Sequence: Synthetic polypeptide
EVQLVESGGGLVQPGGSLRLSCAASGRTHSIYPMGWFRQAPGKERELVAAIHSGGATVYADSVKGRFTISADNSKNTAYLQMNSLKPEDTAVYYCAARRWIPPGPIWGQGTLVTVSS

SEQ ID NO: 1900 - protein, 115 aa, Artificial Sequence
  Description of Artificial Sequence: Synthetic polypeptide
EVQLVESGGGLVQPGGSLRLSCAASGPTFSIYAMGWFRQAPGKEREFVAGIRWSDVYTQYADSVKGRFTISADNSKNTAYLQMNSLKPEDTAVYYCALDIDYRDWGQGTLVTVSS

SEQ ID NO: 1901 - protein, 132 aa, Artificial Sequence
  Description of Artificial Sequence: Synthetic polypeptide
EVQLVESGGGLVQPGGSLRLSCAASGLTFDDNIHVMGWFPQAPGKEREFVAAIHWSGGSTIYADSVKGRFTINADNSKNTAYLQMNSLKPEDTAVYYCAADVYPQDYGLGYVEGKMYYGMDWGQGTLVTVSS

SEQ ID NO: 1902 - protein, 116 aa, Artificial Sequence
  Description of Artificial Sequence: Synthetic polypeptide
EVQLVESGGGLVQPGGSLRLSCAASGLTLDYYAMGWFRQAPGKEREWVASINWSGGSTYYADSVKGRFTISADNSKNTAYLQMNSLKPEDTAVYYCAAYGSGEFDWGQGTLVTVSS

SEQ ID NO: 1903 - protein, 114 aa, Artificial Sequence
  Description of Artificial Sequence: Synthetic polypeptide
EVQLVESGGGLVQPGGSLRLSCAASGRTIVPYTMGWFRQAPGKERELVAAISPSAFTEYADSVKGRFTISADNSKNTAYLQMNSLKPEDTAVYYCAARRWGYDWGQGTLVTVSS

SEQ ID NO: 1904 - protein, 123 aa, Artificial Sequence
  Description of Artificial Sequence: Synthetic polypeptide
EVQLVESGGGLVQPGGSLRLSCAASGGTFTTYHMGWFRQAPGKEREFVAHISTGGATNYADSVKGRFTISADNSKNTAYLQMNSLKPEDTAVYYCATFPAIVTDSDYDLGNDWGQGTLVTVSS

SEQ ID NO: 1905 - protein, 124 aa, Artificial Sequence
  Description of Artificial Sequence: Synthetic polypeptide
EVQLVESGGGLVQPGGSLRLSCAASGFTFNVFAMGWFRQAPGKEREFVAAINWSDSRTDYADSVKGRFTISADNSKNTAYLQMNSLKPEDTAVYYCASGSDNRARELSRYEYVWGQGTLVTVSS

SEQ ID NO: 1906 - protein, 117 aa, Artificial Sequence
  Description of Artificial Sequence: Synthetic polypeptide
EVQLVESGGGLVQPGGSLRLSCAASGSIFSIDVMGWFRQAPGKEREFVAAISWSGESTLYADSVKGRFTISADNSKNTAYLQMNSLKPEDTAVYYCAAFDGYSGSDWGQGTLVTVSS

SEQ ID NO: 1907 - protein, 117 aa, Artificial Sequence
  Description of Artificial Sequence: Synthetic polypeptide
EVQLVESGGGLVQPGGSLRLSCAASGFTFSSYSMGWFRQAPGKEREFVAAISSYSHTAYADSVKGRFTIIADNSKNTAYLQMNSLKPEDTAVYYCALQPFGASSYRWGQGTLVTVSS

SEQ ID NO: 1908 - protein, 117 aa, Artificial Sequence
  Description of Artificial Sequence: Synthetic polypeptide
EVQLVESGGGLVQPGGSLRLSCAASGNTFSINVMGWFRQAPGKEREFVAAIHWSGDSTLYADSGKGRFTIIADNNKNTAYLQMISLKPEDTAVYYCAAFDGYSGNHWGQGTLVTVSS

SEQ ID NO: 1909 - protein, 123 aa, Artificial Sequence
  Description of Artificial Sequence: Synthetic polypeptide
EVQLVESGGGLVQPGGSLRLSCAASGRTISSYIMGWFRQAPGKERELVARIYTGGDTIYADSVKGRFTISADNSKNTAYLQMNSLKPEDTAVYYCAARTSYNGRYDYIDDYSWGQGTLVTVSS

SEQ ID NO: 1910 - protein, 122 aa, Artificial Sequence
  Description of Artificial Sequence: Synthetic polypeptide
EVQLVESGGGLVQPGGSLRLSCAASGRANSINWMGWFRQAPGKEREFVATITPGGNTNYADSVKGRFTISADNSKNTAYLQMNSLKPEDTAVYYCAAAAGSTWYGTLYEYDWGQGTLVTVSS

SEQ ID NO: 1911 - protein, 113 aa, Artificial Sequence
  Description of Artificial Sequence: Synthetic polypeptide
EVQLVESGGGLVQPGGSLRLSCAASGGTFSVFAMGWFRQVPGKERELVAEITAGGSTYYADSVKGRFTISADNSKNTAYLQMNSLKPEDTAVYYCAVDGPFGWGQGTLVTVSS

SEQ ID NO: 1912 - protein, 115 aa, Artificial Sequence
  Description of Artificial Sequence: Synthetic polypeptide
EVQLVESGGGLVQPGGSLRLSCAASGFTFDDYPMGWFRQAPGKEREGVASVLRGGYTWYADSVKGRFTISADNSKNTAYLQMNSLKPEDTAVYYCAKDWATGLAWGQGTLVTVSS

SEQ ID NO: 1913 - protein, 120 aa, Artificial Sequence
  Description of Artificial Sequence: Synthetic polypeptide
EVQLVESGGGLVQPGGSLRLSCAASGFALGYYAMGWFRQAPGKEREFVAGIRWTDAYTEYADSVKGRFTISADNSKNTAYLQMNSLKPEDTAVYYCAADVSPSYGSRWYWGQGTLVTVSS

SEQ ID NO: 1914 - protein, 117 aa, Artificial Sequence
  Description of Artificial Sequence: Synthetic polypeptide
EVQLVESGGGLVQPGGSLRLSCAASGRTLDIHVMGWFRQAPGKEREFVAVINWTGESTLYADSVKGRFTISADNSKNTAYLQMNSLKPEDTAVYYCAAFDGYTGNYWGQGTLVTVSS

SEQ ID NO: 1915 - protein, 118 aa, Artificial Sequence
  Description of Artificial Sequence: Synthetic polypeptide
EVQLVESGGGLVQPGGSLRLSCAASGFTPDNYAMGWFRQAPGKEREFVAALGWSGVTTYHYYADSVKGRFTISADNSKNTAYLQMNSLKPEDTAVYYCASDESDAANWGQGTLVTVSS

SEQ ID NO: 1916 - protein, 114 aa, Artificial Sequence
  Description of Artificial Sequence: Synthetic polypeptide
EVQLVESGGGLVQPGGSLRLSCAASGFTFDDYAMGWFRQAPGKERELVATIMWSGNTTYYADSVRRRFIIRDNNNKNTAHLQMNSLKPEDTAVYYCATNDDDVWGQGTLVTVSS

SEQ ID NO: 1917 - protein, 124 aa, Artificial Sequence
  Description of Artificial Sequence: Synthetic polypeptide
EVQLVESGGGLVQPGGSLRLSCAASGRTFSRYIMGWFRQAPGKEREFVAAISWSGGDNTYYADSVKGRFTISADNSKNTAYLQMNSLKPEDTAVYYCAAYRIVVGGTSPGDWRWGQGTLVTVSS

SEQ ID NO: 1918 - protein, 117 aa, Artificial Sequence
  Description of Artificial Sequence: Synthetic polypeptide
EVQLVESGGGLVQPGGSLRLSCAASGPTFSIYAMGWFRQAPGKERELVAGISWNGGSTNYADSVKGRFTISADNSKNTAYLQMNSLKPEDTAVYYCALRRRFGGQEWGQGTLVTVSS

SEQ ID NO: 1919 - protein, 116 aa, Artificial Sequence
  Description of Artificial Sequence: Synthetic polypeptide
EVQLVESGGGLVQPGGSLRLSCAASGRTFSLNAMGWFRQAPGKERELVAAISCGGGSTYADNGKGRFTIITDNSKNTAYLQMMNLKPEDTAAYYCAADNDMGYCSWGQGTLVTVSS

SEQ ID NO: 1920 - protein, 123 aa, Artificial Sequence
  Description of Artificial Sequence: Synthetic polypeptide
EVQLVESGGGLVQPGGSLRLSCAASGSTFSINAMGWFRQAPGKEREFVGGISRSGATTNYADSVKGRFTISADNSKNTAYLQMNSLKPEDTAVYYCAADGVPEYSDYASGPVWGQGTLVTVSS

SEQ ID NO: 1921 - protein, 120 aa, Artificial Sequence
  Description of Artificial Sequence: Synthetic polypeptide
EVQLVESGGGLVQPGGSLRLSCAASGRTFSMHAMGWFRQAPGKERELVASISSQGRTNYADSVKGRFTISADNSKNTAYLQMNSLKPEDTAVYYCAAEVRNGSDYLPIDWGQGTLVTVSS

SEQ ID NO: 1922 - protein, 115 aa, Artificial Sequence
  Description of Artificial Sequence: Synthetic polypeptide
EVQLVESGGGLVQPGGSLRLSCAASGVTLDLYAMGWFRQAPGKEREFVAGIRWTDAYTEYADSVKGRFTISADNSKNTAYLQMNSLKPEDTAVYYCAVDIDYRDWGQGTLVTVSS

SEQ ID NO: 1923 - protein, 117 aa, Artificial Sequence
  Description of Artificial Sequence: Synthetic polypeptide
EVQLVESGGGLVQPGGSLRLSCAASGLPFTINVMGWFRQAPGKEREFVAAIHWSGLTTFYADSVKGLFTITEDNSKNTAHLMMNLLKPEDTAVYCCAELDGYFFAHWGQGTLVTVSS

SEQ ID NO: 1924 - protein, 123 aa, Artificial Sequence
  Description of Artificial Sequence: Synthetic polypeptide
EVQLVESGGGLVQPGGSLRLSCAASGRAFSNYAMGWFRQAPGKEREFVAWINNRGTTDYADSGSTYYADSVKGRFTISADNSKNTAYLQMNSLKPEDTAVYYCASTDDYGVDWGQGTLVTVSS

SEQ ID NO: 1925 - protein, 120 aa, Artificial Sequence
  Description of Artificial Sequence: Synthetic polypeptide
EVQLVESGGGLVQPGGSLRLSCAASGFTPDDYAMGWFRQAPGKEREFVASIGYSGRSNSYNYYADSVKGRFTISADNSKNTAYLQMNSLKPEDTAVYYCAIAHGSSTYNWGQGTLVTVSS

SEQ ID NO: 1926 - protein, 117 aa, Artificial Sequence
  Description of Artificial Sequence: Synthetic polypeptide
EVQLVESGGGLVQPGGSLRLSCAASGFTLNYYGMGWFPQAPGKEREFVAAITSGGAPHYADSVKGRFTINADNSKNTAYLQMNSLKPEDTAVYYCASAYDRGIGYDWGQGTLVTVSS

SEQ ID NO: 1927 - protein, 122 aa, Artificial Sequence
  Description of Artificial Sequence: Synthetic polypeptide
EVQLVESGGGLVQPGGSLRLSCAASGLPFSTKSMGWFRQAPGKEREFVAAIHWSGLTSYADSVKGRFTISADNSKNTAYLQMNSLKPEDTAVYYCAADRAADFFAQRDEYDWGQGTLVTVSS

SEQ ID NO: 1928 - protein, 117 aa, Artificial Sequence
  Description of Artificial Sequence: Synthetic polypeptide
EVQLVESGGGLVQPGGSLRLSCAASGRTFSINAMGWFPQAPGKERELVAAISWSGESTQYADSVKGRFTISADNSKNTAYLQMNSLKPEDTAVYYCAAFDGGSGTQWGQGTLVTVSS

SEQ ID NO: 1929 - protein, 117 aa, Artificial Sequence
  Description of Artificial Sequence: Synthetic polypeptide
EVQLVESGGGLVQPGGSLRLSCAASGEEFSDHWMGWFRQAPGKEREFVAAIHWSGDSTHRNYADSVKGRFTISADNSKNTAYLQMNSLKPEDTAVYYCATVGITLNWGQGTLVTVSS

SEQ ID NO: 1930 - protein, 118 aa, Artificial Sequence
  Description of Artificial Sequence: Synthetic polypeptide
EVQLVESGGGLVQPGGSLRLSCAASGFTFGSYDMGWFRQAPGKEREFVTAINWSGARTAYADSVKGRFTISADNSKNTAYLQMNSLKPEDTAVYYCAARSVYSYEYNWGQGTLVTVSS

SEQ ID NO: 1931 - protein, 115 aa, Artificial Sequence
  Description of Artificial Sequence: Synthetic polypeptide
EVQLVESGGGLVQPGGSLRLSCAASGLPLDLYAMGWFPPAPGKELEFVAGIRWSDAYTEYADSVKGRFTINADNSKNPANLQMNSLKPEDTAVYYCALDIDYRHWGQGTLVTVSS

SEQ ID NO: 1932 - protein, 121 aa, Artificial Sequence
  Description of Artificial Sequence: Synthetic polypeptide
EVQLVESGGGLVQPGGSLRLSCAASGRTSTVNGMGWFRQAPGKEREFVASISQSGAATAYADSVKGRFTISADNSKNTAYLQMNSLKPEDTAVYYCAADRTYSYSSTGYYWGQGTLVTVSS

SEQ ID NO: 1933 - protein, 117 aa, Artificial Sequence
  Description of Artificial Sequence: Synthetic polypeptide
EVQLVESGGGLVQPGGSLRLSCAASGFSLDYYGMGWFRQAPGKEREFVAAITSGGTPHYADSVKGRFTISADNSKNTAYLQMNSLKPEDTAVYYCASAYNPGIGYDWGQGTLVTVSS

SEQ ID NO: 1934 - protein, 122 aa, Artificial Sequence
  Description of Artificial Sequence: Synthetic polypeptide
EVQLVESGGGLVQPGGSLRLSCAASGRPNSINWMGWFRQAPGKERQFVATITPGGNTNYADSVKGRFTISADNSKNTAYLLMNSLKPEDTAVYYCAAAAGTTWYGTLYEYDWGQGTLVTVSS

SEQ ID NO: 1935 - protein, 122 aa, Artificial Sequence
  Description of Artificial Sequence: Synthetic polypeptide
EVQLVESGGGLVQPGGSLRLSCAASGEKFSDHWMGWFRQAPGKEREFVATITFSGARTAYADSVKGRFTISADNSKNTAYLQMNSLKPEDTAVYYCAALIKPSSTDRIFEEWGQGTLVTVSS

SEQ ID NO: 1936 - protein, 115 aa, Artificial Sequence
  Description of Artificial Sequence: Synthetic polypeptide
EVQLVESGGGLVQPGGSLRLSCAASGLTVVPYAMGWFRQAPGKEREFVAAIRRSAVTNYADSVKGRFTIIADNSKNTAYLLMNSLKPEDTAVYYCAARRWGYHYWGQGTLVTVSS

SEQ ID NO: 1937 - protein, 117 aa, Artificial Sequence
  Description of Artificial Sequence: Synthetic polypeptide
EVQLVESGGGLVQPGGSLRLSCAASGTTFNFNVMGWFRQAPGKERELVAVISWTGESTLYADSVKGRFTISADNSKNTAYLQMNSLKPEDTAVYYCAAFDGYTGRDWGQGTLVTVSS

SEQ ID NO: 1938 - protein, 123 aa, Artificial Sequence
  Description of Artificial Sequence: Synthetic polypeptide
EVQLVESGGGLVQPGGSLRLSCAASGIDVNRNAMGWFRQAPGKEREFVAAITWSGGWRYYADSVKGRFTISADNSKNTAYLQMNSLKPEDTAVYYCATTFGDAGIPDQYDFGWGQGTLVTVSS

SEQ ID NO: 1939 - protein, 111 aa, Artificial Sequence
  Description of Artificial Sequence: Synthetic polypeptide
EVQLVESGGGLVQPGGSLRLSCAASGRTFSSNMGWFRQAPGKEREFVARIFGGDRTLYADSVKGRFTISADNSKNTAYLQMNSLKPEDTAVYYCADINGDWGQGTLVTVSS

SEQ ID NO: 1940 - protein, 111 aa, Artificial Sequence
  Description of Artificial Sequence: Synthetic polypeptide
EVQLVESGGGLVQPGGSLRLSCAASGGTFSMGWIRWVPQAQGKELEFMGCIGWITYYADYAKSRFSLFTDNADNTKNPPNMHMNPQKPEDTAVYYCAPFGWGQGTLVTVSS

SEQ ID NO: 1941 - protein, 120 aa, Artificial Sequence
  Description of Artificial Sequence: Synthetic polypeptide
EVQLVESGGGLVQPGGSLRLSCAASGCTLDYYAMGWFRQAPGKEREFVAGIRWTDAYTEYADSVKGRFTISADNSKNTAYLQMNSLKPEDTAVYYCAADVSPSYGGRWYWGQGTLVTVSS

SEQ ID NO: 1942 - protein, 124 aa, Artificial Sequence
  Description of Artificial Sequence: Synthetic polypeptide
EVQLVESGGGLVQPGGSLRLSCAASGLTFSLYRMCWFRQAPGKEREEVSCISNIDGSTYYADSVKGRFTISADNSKNTAYLQMNSLKPEDTAVYYCAADLLGDSDYEPSSGFGWGQGTLVTVSS

SEQ ID NO: 1943 - protein, 120 aa, Artificial Sequence
  Description of Artificial Sequence: Synthetic polypeptide
EVQLVESGGGLVQPGGSLRLSCAASGRSFSSHRMGWFRQAPGKEREFVAAIMWSGSHRNYADSVKGRFTISADNSKNTAYLQMNSLKPEDTAVYYCAAIAYEEGVYRWDWGQGTLVTVSS

SEQ ID NO: 1944 - protein, 114 aa, Artificial Sequence
  Description of Artificial Sequence: Synthetic polypeptide
EVQLVESGGGLVQPGGSLRLSCAASGRIIVPNTMGWFRQAPGKERERVTGISPSAFTEYADSVKGRFTISADNSKNTAYLQMNSLKPEDTAVYYCAAHGWGCHWGQGTLVTVSS

SEQ ID NO: 1945 - protein, 122 aa, Artificial Sequence
  Description of Artificial Sequence: Synthetic polypeptide
EVQLVESGGGLVQPGGSLRLSCAASGSIFIISMGWFRQAPGKEHEFVTGINWSGGSTTYADSVKGRFTINADNSKNTAYLQMNSLKPEDTAVYYCAASAIGSGALRRFEYDWGQGTLVTVSS

SEQ ID NO: 1946 - protein, 120 aa, Artificial Sequence
  Description of Artificial Sequence: Synthetic polypeptide
EVQLVESGGGLVQPGGSLRLSCAASGFSLDYYDMGWFRQAPGKEREFVAALGWSGGSTDYADSVKGRFTISADNSKNTAYLQMNSLKPEDTAVYYCAAGNGGRYGIVERWGQGTLVTVSS

SEQ ID NO: 1947 - protein, 122 aa, Artificial Sequence
  Description of Artificial Sequence: Synthetic polypeptide
EVQLVESGGGLVQPGGSLRLSCAASGTSISNRVMGWFRQAPGKERELVARIYTGGDTLYADSVKGRFTISADNSKNTAYLQMNSLKPEDTAVYYCAARKIYRSLSYYGDYDWGQGTLVTVSS

SEQ ID NO: 1948 - protein, 119 aa, Artificial Sequence
  Description of Artificial Sequence: Synthetic polypeptide
EVQLVESGGGLVQPGGSLRLSCAASGNIDRLYAMGWFRQAPGKEREGVAAIDSDGSTDYADSVKGRFTISADNSKNTAYLQMNSLKPEDTAVYYCAALIDYGLGFPIEWGQGTLVTVSS

SEQ ID NO: 1949 - protein, 117 aa, Artificial Sequence
  Description of Artificial Sequence: Synthetic polypeptide
EVQLVESGGGLVQPGGSLRLSCAASGNTFTINVMGWFRQAPGKEREFVAAINWNGGTTLYADSVKGRFTISADNSKNTAYLQMNSLKPEDTAVYYCAAFDGYSGIDWGQGTLVTVSS

SEQ ID NO: 1950 - protein, 115 aa, Artificial Sequence
  Description of Artificial Sequence: Synthetic polypeptide
EVQLVESGGGLVQPGGSLRLSCAASGFNVNDYAMGWFRQAPGKEREFVAGITSSVGVTNYADSVKGRFTISADNSKNTAYLQMNSLKPEDTAVYYCAADIFFVNWGRGTLVTVSS

SEQ ID NO: 1951 - protein, 125 aa, Artificial Sequence
  Description of Artificial Sequence: Synthetic polypeptide
EVQLVESGGGLVQPGGSLRLSCAASGFTFDHYTMGWFRQAPGKEREFVAAISGSENVTSYADSVKGRFTISADNSKNTAYLQMNSLKPEDTAVYYCAAEPYIPVRTMRHMTFLTWGQGTLVTVSS

SEQ ID NO: 1952 - protein, 115 aa, Artificial Sequence
  Description of Artificial Sequence: Synthetic polypeptide
EVQLVESGGGLVQPGGSLRLSCAASGRTFGNYNMGWFRQAPGKEREFVATINSLGGTSYADSVKGRFTISADNSKNTAYLQMNSLKPEDTAVYYCARVDYYMDVWGQGTLVTVSS

SEQ ID NO: 1953 - protein, 118 aa, Artificial Sequence
  Description of Artificial Sequence: Synthetic polypeptide
EVQLVESGGGLVQPGGSLRLSCAASGFTMSSSWMGWFRQAPGKEREFVTVISGVGTSYADSVKGRFTISADNSKNTAYLQMNSLKPEDTAVYYCARGPDSSGYGFDYWGQGTLVTVSS

SEQ ID NO: 1954 - protein, 115 aa, Artificial Sequence
  Description of Artificial Sequence: Synthetic polypeptide
EVQLVESGGGLVQPGGSLRLSCAASGFTFSPSWMGWFRQAPGKEREFVATINEYGGRNYADSVKGRFTISADNSKNTAYLQMNSLKPEDTAVYYCARVDRDFDYWGQGTLVTVSS

SEQ ID NO: 1955 - protein, 121 aa, Artificial Sequence
  Description of Artificial Sequence: Synthetic polypeptide
EVQLVESGGGLVQPGGSLRLSCAASGFTRDYYTMGWFRQAPGKEREFVAAISRSGSLTSYADSVKGRFTISADNSKNTAYLQMNSLKPEDTAVYYCANLAYYDSSGYYDYWGQGTLVTVSS

SEQ ID NO: 1956 - protein, 112 aa, Artificial Sequence
  Description of Artificial Sequence: Synthetic polypeptide
EVQLVESGGGLVQPGGSLRLSCAASGRTFTMGWFRQAPGKEREFVASTNSAGSTNYADSVNGRFTISADNSKNTAYLQMNSLKPEDTAVYYCTTVDQYFDYWGQGTLVTVSS

SEQ ID NO: 1957 - protein, 119 aa, Artificial Sequence
  Description of Artificial Sequence: Synthetic polypeptide
EVQLVESGGGLVQPGGSLRLSCAASGTTLDYYAMGWFRQAPGKERELVAAISWSGGSTAYADSVKGRFTISADNSKNTAYLQMNSLKPEDTAVYYCAREDYYDSSGYSWGQGTLVTVSS

SEQ ID NO: 1958 - protein, 115 aa, Artificial Sequence
  Description of Artificial Sequence: Synthetic polypeptide
EVQLVESGGGLVQPGGSLRLSCAASGFTFSSYWMGWFRQAPGKEREFVATINWSGVTAYADSVKGRFTISADNSKNTAYLQMNSLKPEDTAVYYCARADDYFDYWGQGTLVTVSS

SEQ ID NO: 1959 - protein, 126 aa, Artificial Sequence
  Description of Artificial Sequence: Synthetic polypeptide
  MOD_RES (63)..(63): Any amino acid
EVQLVESGGGLVQPGGSLRLSCAASGFTLSGIWMGWFLQAPGKEHEFVAIITTGGRTTYADSXKGRFTSSSDNSKNTAYLQMNLLKPEDTAEYYCAGYSTFGSSSAYYYYSMDVGWGQGTLVTVSS

SEQ ID NO: 1960 - protein, 114 aa, Artificial Sequence
  Description of Artificial Sequence: Synthetic polypeptide
EVQLVESGGGLVQPGGSLRLSCAASGFTFDYYAMGWFRQAPGKEREFVSAIDSEGRTSYADSVKGRFTISADNSKNTAYLQMNSLKPEDTAVYYCARWGPFDIWGQGTLVTVSS

SEQ ID NO: 1961 - protein, 125 aa, Artificial Sequence
  Description of Artificial Sequence: Synthetic polypeptide
EVQLVESGGGLVQPGGSLRLSCAASGSIASIHAMGWFRQAPGKEREFVAAISRSGGFGSYADSVKGRFTISADNSKNTAYLQMNSLKPEDTAVYYCARDDKYYDSSGYPAYFQHWGQGTLVTVSS

SEQ ID NO: 1962 - protein, 113 aa, Artificial Sequence
  Description of Artificial Sequence: Synthetic polypeptide
EVQLVESGGGLVQPGGSLRLSCAASGLAFNAYAMGWFRQAPGKEREEVATIGWSGANTYYADSVKGRFTISADNSKNTAYLQMNSLKPEDTAVYYCASDPPGWGQGTLVTVSS

SEQ ID NO: 1963 - protein, 116 aa, Artificial Sequence
  Description of Artificial Sequence: Synthetic polypeptide
EVQLVESGGGLVQPGGSLRLSCAASGSTYTTYSMGWFRQAPGKEREFVAAISGSENVTSYADSVKGRFTISADNSKNTAYLQMNSLKPEDTAVYYCARVDDYMDVWGQGTLVTVSS

SEQ ID NO: 1964 - protein, 123 aa, Artificial Sequence
  Description of Artificial Sequence: Synthetic polypeptide
EVQLVESGGGLVQPGGSLRLSCAASGLTFNDYAMGWFRQAPGKEREFVAHIPRSTYSPYYADSVKGRFTISADNSKNTAYLQMNSLKPEDTAVYYCAFLVGPQGVDHGAFDVWGQGTLVTVSS

SEQ ID NO: 1965 - protein, 116 aa, Artificial Sequence
  Description of Artificial Sequence: Synthetic polypeptide
EVQLVESGGGLVQPGGSLRLSCAASGITFRFKAMGWFRQAPGKEREFVAAVSWDGRNTYYADSVKGRFTISADNSKNTAYLQMNSLKPEDTAVYYCASDYYYMDVWGQGTLVTVSS

SEQ ID NO: 1966 - protein, 118 aa, Artificial Sequence
  Description of Artificial Sequence: Synthetic polypeptide
EVQLVESGGGLVQPGGSLRLSCAASGSTVLINAMGWFRQAPGKEREFVAAVRWSDDYTYYADSVKGRFTISADNSKNTAYLQMNSLKPEDTAVYYCAKEGRAGSLDYWGQGTLVTVSS

SEQ ID NO: 1967 - protein, 123 aa, Artificial Sequence
  Description of Artificial Sequence: Synthetic polypeptide
EVQLVESGGGLVQPGGSLRLSCAASGFTFDDAAMGWFRQAPGKEREFVAHISWSGGSTYYADSVKGRFTISADNSKNTAYLQMNSLKPEDTAVYYCATFGATVTATNDAFDIWGQGTLVTVSS

SEQ ID NO: 1968 - protein, 123 aa, Artificial Sequence
  Description of Artificial Sequence: Synthetic polypeptide
EVQLVESGGGLVQPGGSLRLSCAASGNTGSTGYMGWFRQAPGKEREMVAGVINDGSTVYADSVKGRFTISADNSKNTAYLQMNSLKPEDTAVYYCARLATSHQDGTGYLFDYWGQGTLVTVSS

SEQ ID NO: 1969 - protein, 125 aa, Artificial Sequence
  Description of Artificial Sequence: Synthetic polypeptide
EVQLVESGGGLVQPGGSLRLSCAASGLTFRNYAMGWFRQAPGKEREFIAGMMWSGGTTTYADSVKGRFTISADNSKNTAYLQMNSLKPEDTAVYYCAREGYYYDSSGYLNYFDYWGQGTLVTVSS

SEQ ID NO: 1970 - protein, 120 aa, Artificial Sequence
  Description of Artificial Sequence: Synthetic polypeptide
EVQLVESGGGLVQPGGSLRLSCAASGSILSIAVMGWFRQAPGKEREFVAAISPSAVTTYYADSVKGRFTISADNSKNTAYLQMNSLKPEDTAVYYCAIGYYDSSGYFDYWGQGTLVTVSS

SEQ ID NO: 1971 - protein, 124 aa, Artificial Sequence
  Description of Artificial Sequence: Synthetic polypeptide
EVQLVESGGGLVQPGGSLRLSCAASGSTLPYHAMGWFRQAPGKEREFVAAITWNGASTSYADSVKGRFTISADNSKNTAYLQMNSLKPEDTAVYYCARDRYYDTSASYFESETWGQGTLVTVSS

SEQ ID NO: 1972 - protein, 122 aa, Artificial Sequence
  Description of Artificial Sequence: Synthetic polypeptide
EVQLVESGGGLVQPGGSLRLSCAASGTLFKINAMGWFRQAPGKEREFVAAITSSGSNIDYTYYADSVKGRFTISADNSKNTAYLQMNSLKPEDTAVYYCARSNTGWYSFDYWGQGTLVTVSS

SEQ ID NO: 1973 - protein, 117 aa, Artificial Sequence
  Description of Artificial Sequence: Synthetic polypeptide
EVQLVESGGGLVQPGGSLRLSCAASGRTFSEVVMGWFRQAPGKEREFVATIHSSGSTSYADSVKGRFTISADNSKNTAYLQMNSLKPEDTAVYYCVRVTSDYSMDSWGQGTLVTVSS

SEQ ID NO: 1974 - protein, 119 aa, Artificial Sequence
  Description of Artificial Sequence: Synthetic polypeptide
EVQLVESGGGLVQPGGSLRLSCAASGSIFSMNTMGWFRQAPGKEREFVALINRSGGGINYADSVKGRFTISADNSKNTAYLQMNSLKPEDTAVYYCVRLSSGYYDFDYWGQGTLVTVSS

SEQ ID NO: 1975 - protein, 128 aa, Artificial Sequence
  Description of Artificial Sequence: Synthetic polypeptide
EVQLVESGGGLVQPGGSLRLSCAASGFTLDYYAMGWFRQAPGKEREFVAAINWSGDNTHYADSVKGRFTISADNSKNTAYLQMNSLKPEDTAVYYCARAPFYCTTTKCQDNYYYMDVWGQGTLVTVSS

SEQ ID NO: 1976 - protein, 122 aa, Artificial Sequence
  Description of Artificial Sequence: Synthetic polypeptide
EVQLVESGGGLVQPGGSLRLSCAASGLTFGTYTMGWFRQAPGKEREFVAAISRFGSTYYADSVKGRFTISADNSKNTAYLQMNSLKPEDTAVYYCARGGDYDFWSVDYMDVWGQGTLVTVSS

SEQ ID NO: 1977 - protein, 115 aa, Artificial Sequence
  Description of Artificial Sequence: Synthetic polypeptide
EVQLVESGGGLVQPGGSLRLSCAASGDTFSTSWMGWFRQAPGKEREFVATINTGGGTNYADSVKGRFTISADNSKNTAYLQMNSLKPEDTAVYYCARVTTSFDYWGQGTLVTVSS

SEQ ID NO: 1978 - protein, 115 aa, Artificial Sequence
  Description of Artificial Sequence: Synthetic polypeptide
EVQLVESGGGLVQPGGSLRLSCAASGITFRFKAMGWFRQAPGKEREFVASISRSGTTYYADSVKGRFTISADNSKNTAYLQMNSLKPEDTAVYYCATDYSAFDMWGQGTLVTVSS

SEQ ID NO: 1979 - protein, 118 aa, Artificial Sequence
  Description of Artificial Sequence: Synthetic polypeptide
EVQLVESGGGLVQPGGSLRLSCAASGDTYGSYWMGWFRQAPGKEREFVATITSDDRTNYADSVKGRFTISADNSKNTAYLQMNSLKPEDTAVYYCARVTSSLSGMDVWGQGTLVTVSS

SEQ ID NO: 1980 - protein, 120 aa, Artificial Sequence
  Description of Artificial Sequence: Synthetic polypeptide
  MOD_RES (47)..(47): Any amino acid
EVQLVESGGGLVQPGGSLRLSCAASGYTLKNYYAMGWFRQAPGKERXLVAAIIWTGESTLDADSVKGRFTISADNSKNTAYLQMNSLKPEDTAVYYCAREGYYDSSGYYWGQGTLVTVSS

SEQ ID NO: 1981 - protein, 115 aa, Artificial Sequence
  Description of Artificial Sequence: Synthetic polypeptide
EVQLVESGGGLVQPGGSLRLSCAASGFAFGDSWMGWFRQAPGKEREFVATINWSGVTAYADSVKGRFTISADNSKNTAYLQMNSLKPEDTAVYYCARADGYFDYWGQGTLVTVSS

SEQ ID NO: 1982 - protein, 119 aa, Artificial Sequence
  Description of Artificial Sequence: Synthetic polypeptide
EVQLVESGGGLVQPGGSLRLSCAASGDTFSANRMGWFRQAPGKEREFVASITWSSANTYYADSVKGRFTISADNSKNTAYLQMNSLKPEDTAVYYCATFNWNDEGFDFWGQGTLVTVSS

SEQ ID NO: 1983 - protein, 124 aa, Artificial Sequence
  Description of Artificial Sequence: Synthetic polypeptide
EVQLVESGGGLVQPGGSLRLSCAASGFTLDYYDMGWFRQAPGKEREFVALISWSGGSTYYADSVKGRFTISADNSKNTAYLQMNSLKPEDTAVYYCATDFYGWGTRERDAFDIWGQGTLVTVSS

SEQ ID NO: 1984 - protein, 119 aa, Artificial Sequence
  Description of Artificial Sequence: Synthetic polypeptide
EVQLVESGGGLVQPGGSLRLSCAASGTFQRINHMGWFRQAPGKEREFVATINTGGQPNYADSVKGRFTISADNSKNTAYLQMNSLKPEDTAVYYCASLIAAQDYYFDYWGQGTLVTVSS

SEQ ID NO: 1985 - protein, 119 aa, Artificial Sequence
  Description of Artificial Sequence: Synthetic polypeptide
EVQLVESGGGLVQPGGSLRLSCAASGSAFRSNAMGWFRQAPGKEREFVAHISWSSKSTYYADSVKGRFTISADNSKNTAYLQMNSLKPEDTAVYYCATYCSSTSCFDYWGQGTLVTVSS

SEQ ID NO: 1986 - protein, 119 aa, Artificial Sequence
  Description of Artificial Sequence: Synthetic polypeptide
EVQLVESGGGLVQPGGSLRLSCAASGFTLAYYAMGWFRQAPGKEREFVAAISMSGDDTIYADSVKGRFTISADNSKNTAYLQMNSLKPEDTAVYYCARELGYSSTVWPWGQGTLVTVSS

SEQ ID NO: 1987 - protein, 123 aa, Artificial Sequence
  Description of Artificial Sequence: Synthetic polypeptide
EVQLVESGGGLVQPGGSLRLSCAASGFDFSVSWMGWFRQAPGKEREFVTAITWSGDSTNYADSVKGRFTISADNSKNTAYLQMNSLKPEDTAVYYCASLLHTGPSGGNYFDYWGQGTLVTVSS

SEQ ID NO: 1988 - protein, 118 aa, Artificial Sequence
  Description of Artificial Sequence: Synthetic polypeptide
EVQLVESGGGLVQPGGSLRLSCAASGHTFSTSWMGWFRQAPGKEREFVATINSLGGTNYADSVKGRFTISADNSKNTAYLQMNSLKPEDTAVYYCARVSSGDYGMDVWGQGTLVTVSS

SEQ ID NO: 1989 - protein, 115 aa, Artificial Sequence
  Description of Artificial Sequence: Synthetic polypeptide
EVQLVESGGGLVQPGGSLRLSCAASGNTFSGGFMGWFRQAPGKEREFVAVISSLSSKSYADSVKGRFTISADNSKNTAYLQMNSLKPEDTAVYYCAKVDSGYDYWGQGTLVTVSS

SEQ ID NO: 1990 - protein, 125 aa, Artificial Sequence
  Description of Artificial Sequence: Synthetic polypeptide
EVQLVESGGGLVQPGGSLRLSCAASGFTFSPSWMGWFRQAPGKEREFVAAISWSGGSTAYADSVKGRFTISADNSKNTAYLQMNSLKPEDTAVYYCHGLGEGDPYGDYEGYFDLWGQGTLVTVSS

SEQ ID NO: 1991 - protein, 120 aa, Artificial Sequence
  Description of Artificial Sequence: Synthetic polypeptide
EVQLVESGGGLVQPGGSLRLSCAASGFTFSDYWMGWFRQAPGKERELVARVWWNGGSAYYADSVKGRFTISADNSKNTAYLQMNSLKPEDTAVYYCAREVLRQQVVLDYWGQGTLVTVSS

SEQ ID NO: 1992 - protein, 128 aa, Artificial Sequence
  Description of Artificial Sequence: Synthetic polypeptide
EVQLVESGGGLVQPGGSLRLSCAASGFTFSTSWMGWFRQAPGKEREFVASINEYGGRNYADSVKGRFTISADNSKNTAYLQMNSLKPEDTAVYYCAGLHYYYDSSGYNPTEYYGMDVWGQGTLVTVSS

SEQ ID NO: 1993 - protein, 119 aa, Artificial Sequence
  Description of Artificial Sequence: Synthetic polypeptide
EVQLVESGGGLVQPGGSLRLSCAASGDTYGSYWMGWFRQAPGKEREFVAVITSGGSTNYADSVKGRFTISADNSKNTAYLQMNSLKPEDTAVYYCTHVQNSYYYAMDVWGQGTLVTVSS

SEQ ID NO: 1994 - protein, 127 aa, Artificial Sequence
  Description of Artificial Sequence: Synthetic polypeptide
EVQLVESGGGLVQPGGSLRLSCAASGRTFSSYAMMGWFRQAPGKEREFVASVNWDASQINYADSVKGRFTISADNSKNTAYLQMNSLKPEDTAVYYCTTLGAVYFDSSGYHDYFDYWGQGTLVTVSS

SEQ ID NO: 1995 - protein, 120 aa, Artificial Sequence
  Description of Artificial Sequence: Synthetic polypeptide
EVQLVESGGGLVQPGGSLRLSCAASGGTFGVYHMGWFRQAPGKEREFIGRITWTDGSTYYADSVKGRFTISADNSKNTAYLQMNSLKPEDTAVYYCFGLLEVYDMTFDYWGQGTLVTVSS

SEQ ID NO: 1996 - protein, 121 aa, Artificial Sequence
  Description of Artificial Sequence: Synthetic polypeptide
EVQLVESGGGLVQPGGSLRLSCAASGNMFSINAMGWFRQAPGKEREFVTLISWSSGRTSYADSVKGRFTISADNSKNTAYLQMNSLKPEDTAVYYCASLGYCSGGSCFDYWGQGTLVTVSS

SEQ ID NO: 1997 - protein, 118 aa, Artificial Sequence
  Description of Artificial Sequence: Synthetic polypeptide
EVQLVESGGGLVQPGGSLRLSCAASGLTFSAMGWFRQAPGKEREFVALIRRDGSTIYADSVKGRFTISADNSKNTAYLQMNSLKPEDTAVYYCAALGILFGYDAFDIWGQGTLVTVSS

SEQ ID NO: 1998 - protein, 123 aa, Artificial Sequence
  Description of Artificial Sequence: Synthetic polypeptide
EVQLVESGGGLVQPGGSLRLSCAASGRTFSMHAMGWFRQAPGKERELVASITYGGNINYADSVKGRFTISADNSKNTAYLQMNSLKPEDTAVYYCAKEGYYDSTGYRTYFQQWGQGTLVTVSS

SEQ ID NO: 1999 - protein, 117 aa, Artificial Sequence
  Description of Artificial Sequence: Synthetic polypeptide
EVQLVESGGGLVQPGGSLRLSCAASGFTVSNYAMGWFRQAPGKEREFVASVNWSGGTTSYADSVKGRFTISADNSKNTAYLQMNSLKPEDTAVYYCATTGTVTLGYWGQGTLVTVSS

SEQ ID NO: 2000 - protein, 121 aa, Artificial Sequence
  Description of Artificial Sequence: Synthetic polypeptide
EVQLVESGGGLVQPGGSLRLSCAASGSTVLINAMGWFRQAPGKEREFVAAISWSPGRTDYADSVKGRFTISADNSKNTAYLQMNSLKPEDTAVYYCARDCSGGSCYSGDYWGQGTLVTVSS

SEQ ID NO: 2001 - protein, 117 aa, Artificial Sequence
  Description of Artificial Sequence: Synthetic polypeptide
EVQLVESGGGLVQPGGSLRLSCAASGFSFDRWAMGWFRQAPGKEREWVASLATGGNTNYADSVKGRFTISADNSKNTAYLQMNSLKPEDTAVYYCARVTNYDAFDIWGQGTLVTVSS

SEQ ID NO: 2002 - protein, 122 aa, Artificial Sequence
  Description of Artificial Sequence: Synthetic polypeptide
EVQLVESGGGLVQPGGSLRLSCAASGYTYSSYVMGWFRQAPGKEREFVAAISRFGSTYYADSVKGRFTISADNSKNTAYLQMNSLKPEDTAVYYCARDSGEHFWDSGYIDHWGQGTLVTVSS

SEQ ID NO: 2003 - protein, 115 aa, Artificial Sequence
  Description of Artificial Sequence: Synthetic polypeptide
EVQLVESGGGLVQPGGSLRLSCAASGDTYGSYWMGWFRQAPGKEREVVAAITSGGSTVYADSVKGRFTISADNSKNTAYLQMNSLKPEDTAVYYCARVDSRFDYWGQGTLVTVSS

SEQ ID NO: 2004 - protein, 117 aa, Artificial Sequence
  Description of Artificial Sequence: Synthetic polypeptide
EVQLVESGGGLVQPGGSLRLSCAASGISINTNVMGWFRQAPGKEREFVAAISTGSVTIYADSVKGRFTISADNSKNTAYLQMNSLKPEDTAVYYCARVDDFGYFDLWGQGTLVTVSS

SEQ ID NO: 2005 - protein, 123 aa, Artificial Sequence
  Description of Artificial Sequence: Synthetic polypeptide
EVQLVESGGGLVQPGGSLRLSCAASGFEFENHWMGWFRQAPGKEREYVAHITAGGLSNYADSVKGRFTISADNSKNTAYLQMNSLKPEDTAVYYCGRHWGIYDSSGFSSFDYWGQGTLVTVSS

SEQ ID NO: 2006 - protein, 115 aa, Artificial Sequence
  Description of Artificial Sequence: Synthetic polypeptide
EVQLVESGGGLVQPGGSLRLSCAASGFTMSSSWMGWFRQAPGKEREFVARITSGGSTGYADSVKGRFTISADNSKNTAYLQMNSLKPEDTAVYYCASVDGYFDYWGQGTLVTVSS

SEQ ID NO: 2007 - protein, 118 aa, Artificial Sequence
  Description of Artificial Sequence: Synthetic polypeptide
EVQLVESGGGLVQPGGSLRLSCAASGNIFRSNMGWFRQAPGKEREFVAGITWNGDTTYYADSVKGRFTISADNSKNTAYLQMNSLKPEDTAVYYCARALGVTYQFDYWGQGTLVTVSS

SEQ ID NO: 2008 - protein, 118 aa, Artificial Sequence
  Description of Artificial Sequence: Synthetic polypeptide
EVQLVESGGGLVQPGGSLRLSCAASGLTFDDHSMGWFRQAPGKEREFVAAVPLSGNTYYADSVKGRFTISADNSKNTAYLQMNSLKPEDTAVYYCASFSGGPADFDYWGQGTLVTVSS

SEQ ID NO: 2009 - protein, 122 aa, Artificial Sequence
  Description of Artificial Sequence: Synthetic polypeptide
EVQLVESGGGLVQPGGSLRLSCAASGRAVSTYAMGWFRQAPGKEREFVAAISGSENVTSYADSVKGRFTISADNSKNTAYLQMNSLKPEDTAVYYCLSVTGDTEDYGVFDTWGQGTLVTVSS

SEQ ID NO: 2010 - protein, 123 aa, Artificial Sequence
  Description of Artificial Sequence: Synthetic polypeptide
EVQLVESGGGLVQPGGSLRLSCAASGISGSVFSRTPMGWFRQAPGKEREWVSSIYSDGSNTYYADSVKGRFTISADNSKNTAYLQMNSLKPEDTAVYYCAHWSWELGDWFDPWGQGTLVTVSS

SEQ ID NO: 2011 - protein, 123 aa, Artificial Sequence
  Description of Artificial Sequence: Synthetic polypeptide
EVQLVESGGGLVQPGGSLRLSCAASGDTYGSYWMGWFRQAPGKEREFVATISQSGAATAYADSVKGRFTISADNSKNTAYLQMNSLKPEDTAVYYCAGLLRYSGTYYDAFDVWGQGTLVTVSS

SEQ ID NO: 2012 - protein, 117 aa, Artificial Sequence
  Description of Artificial Sequence: Synthetic polypeptide
EVQLVESGGGLVQPGGSLRLSCAASGDTYGSYWMGWFRQAPGKEREFVAAINWSGGSTNYADSVKGRFTITADNNKNTAYLQMNSLKPEDTAVYYCAGLGWNYMDYWGQGTLVTVSS

SEQ ID NO: 2013 - protein, 118 aa, Artificial Sequence
  Description of Artificial Sequence: Synthetic polypeptide
EVQLVESGGGLVQPGGSLRLSCAASGSTFSGNWMGWFRQAPGKEREFVAVISWTGGSTYYADSVKGRFTISADNSKNTAYLQMNSLKPEDTAVYYCATHNSLSGFDYWGQGTLVTVSS

SEQ ID NO: 2014 - protein, 113 aa, Artificial Sequence
  Description of Artificial Sequence: Synthetic polypeptide
EVQLVESGGGLVQPGGSLRLSCAASGQTFNMGWFRQAPGKEREFVAAIGSGGSTSYADSVKGRFTISADNSKNTAYLQMNSLKPEDTAVYYCWRLGNDYFDYWGQGTLVTVSS

SEQ ID NO: 2015 - protein, 116 aa, Artificial Sequence
  Description of Artificial Sequence: Synthetic polypeptide
EVQLVESGGGLVQPGGSLRLSCAASGIPSIHAMGWFRQAPGKERELVAAINWSHGVTYYADSVKGRFTISADNSKNTAYLQMNSLKPEDTAVYYCGGGYGYHFDYWGQGTLVTVSS

SEQ ID NO: 2016 - protein, 126 aa, Artificial Sequence
  Description of Artificial Sequence: Synthetic polypeptide
EVQLVESGGGLVQPGGSLRLSCAASGLPFSTLHMGWFRQAPGKEREFVASLSIFGATGYADSVKGRFTISADNSKNTAYLQMNSLKPEDTAVYYCWMYYYDSSGYYGNYYYGMDVWGQGTLVTVSS

SEQ ID NO: 2017 - protein, 126 aa, Artificial Sequence
  Description of Artificial Sequence: Synthetic polypeptide
EVQLVESGGGLVQPGGSLRLSCAASGLTFSLFAMGWFRQAPGKERELVAAISSGGSTDYADSVKGRFTISADNSKNTAYLQMNSLKPEDTAVYYCARGNTKYYYDSSGYSSAFDYWGQGTLVTVSS

SEQ ID NO: 2018 - protein, 119 aa, Artificial Sequence
  Description of Artificial Sequence: Synthetic polypeptide
EVQLVESGGGLVQPGGSLRLSCAASGSFSNYAMGWFRQAPGKEREFVAAISSSGALTSYADSVKGRFTISADNSKNTAYLQMNSLKPEDTAVYYCWIVGPGPLDGMDVWGQGTLVTVSS

SEQ ID NO: 2019 - protein, 120 aa, Artificial Sequence
  Description of Artificial Sequence: Synthetic polypeptide
EVQLVESGGGLVQPGGSLRLSCAASGFTLSDRAMGWFRQAPGKEREYVAHITAGGLSNYADSVKGRFTISADNSKNTAYLQMNSLKPEDTAVYYCVHLASQTGAGYFDLWGQGTLVTVSS

SEQ ID NO: 2020 - protein, 117 aa, Artificial Sequence
  Description of Artificial Sequence: Synthetic polypeptide
EVQLVESGGGLVQPGGSLRLSCAASGGTFSSVGMGWFRQAPGKEREFVAGISRSGGTYYADSVKGRFTISADNSKNTAYLQMNSLKPEDTAVYYCARYDFWSGYPYWGQGTLVTVSS

SEQ ID NO: 2021 - protein, 123 aa, Artificial Sequence
  Description of Artificial Sequence: Synthetic polypeptide
EVQLVESGGGLVQPGGSLRLSCAASGFNLDDYADMGWFRQAPGKEREFVAAIGWGGGSTRYADSVKGRFTISADNSKNTAYLQMNSLKPEDTAVYYCAREILWFGEFGEPNVWGQGTLVTVSS

SEQ ID NO: 2022 - protein, 123 aa, Artificial Sequence
  Description of Artificial Sequence: Synthetic polypeptide
EVQLVESGGGLVQPGGSLRLSCAASGITFSNDAMGWFRQAPGKEREFVAIITSSDTNDTTNYADSVKGRFTISADNSKNTAYLQMNSLKPEDTAVYYCARLHYYDSSGYFDYWGQGTLVTVSS

SEQ ID NO: 2023 - protein, 120 aa, Artificial Sequence
  Description of Artificial Sequence: Synthetic polypeptide
EVQLVESGGGLVQPGGSLRLSCAASGSTLSINAMGWFRQAPGKEREFVAAIDWSGGSTAYADSVKGRFTISADNSKNTAYLQMNSLKPEDTAVYYCARDSSATRTGPDYWGQGTLVTVSS

SEQ ID NO: 2024 - protein, 116 aa, Artificial Sequence
  Description of Artificial Sequence: Synthetic polypeptide
EVQLVESGGGLVQPGGSLRLSCAASGHTFSGYAMGWFRQAPGKEREFVAVITREGSTYYADSVKGRFTISADNSKNTAYLQMNSLKPEDTAVYYCARLGGEGFDYWGQGTLVTVSS

SEQ ID NO: 2025 - protein, 119 aa, Artificial Sequence
  Description of Artificial Sequence: Synthetic polypeptide
EVQLVESGGGLVQPGGSLRLSCAASGFAFGDSWMGWFRQAPGKERELVAAITSGGSTDYADSVKGRFTISADNSKNTAYLQMNSLKPEDTAVYYCARGLLWFGELFGYWGQGTLVTVSS

SEQ ID NO: 2026 - protein, 121 aa, Artificial Sequence
  Description of Artificial Sequence: Synthetic polypeptide
EVQLVESGGGLVQPGGSLRLSCAASGGTFSTYWMGWFRQAPGKEREFVAAISRSGGNTYYADSVKGRFTISADNSKNTAYLQMNSLKPEDTAVYYCVRHSGTDGDSSFDYWGQGTLVTVSS

SEQ ID NO: 2027 - protein, 115 aa, Artificial Sequence
  Description of Artificial Sequence: Synthetic polypeptide
EVQLVESGGGLVQPGGSLRLSCAASGLAFDFDGMGWFRQAPGKEREGVAAINSGGSTYYADSVKGRFTISADNSKNTAYLQMNSLKPEDTAVYYCARFFRAHDYWGQGTLVTVSS

SEQ ID NO: 2028 - protein, 115 aa, Artificial Sequence
  Description of Artificial Sequence: Synthetic polypeptide
EVQLVESGGGLVQPGGSLRLSCAASGFTFDRSWMGWFRQAPGKEREFVAAVTEGGTTSYADSVKGRFTISADNSKNTAYLQMNSLKPEDTAVYYCARADYDFDYWGQGTLVTVSS

SEQ ID NO: 2029 - protein, 119 aa, Artificial Sequence
  Description of Artificial Sequence: Synthetic polypeptide
EVQLVESGGGLVQPGGSLRLSCAASGRTYDAMGWFRQAPGKEREFVASVTSGGYTHYADSVKGRFTISADNSKNTAYLQMNSLKPEDTAVYYCAKFGRKIVGATELDYWGQGTLVTVSS

SEQ ID NO: 2030 - protein, 124 aa, Artificial Sequence
  Description of Artificial Sequence: Synthetic polypeptide
EVQLVESGGGLVQPGGSLRLSCAASGSISSIDYMGWFRQAPGKEREGVSWISSSDGSTYYADSVKGRFTISADNSKNTAYLQMNSLKPEDTAVYYCARSPSFSQIYYYYYMDVWGQGTLVTVSS

SEQ ID NO: 2031 - protein, 124 aa, Artificial Sequence
  Description of Artificial Sequence: Synthetic polypeptide
EVQLVESGGGLVQPGGSLRLSCAASGGTFSFYNMGWFRQAPGKEREFVAFISGNGGTSYADSVKGRFTISADNSKNTAYLQMNSLKPEDTAVYYCAVVAMRMVTTEGPDVLDVWGQGTLVTVSS

SEQ ID NO: 2032 - protein, 125 aa, Artificial Sequence
  Description of Artificial Sequence: Synthetic polypeptide
EVQLVESGGGLVQPGGSLRLSCAASGFIGNYHAMGWFRQAPGKEREFVAAVTWSGGTTNYADSVKGRFTISADNSKNTAYLQMNSLKPEDTAVYYCAREGYYYDSSGYPYYFDYWGQGTLVTVSS

SEQ ID NO: 2033 - protein, 119 aa, Artificial Sequence
  Description of Artificial Sequence: Synthetic polypeptide
EVQLVESGGGLVQPGGSLRLSCAASGSSLDAYGMGWFRQAPGKEREFVAAISWGGGSIYYADSVKGRFTISADNSKNTAYLQMNSLKPEDTAVYYCARLSQGMVALDYWGQGTLVTVSS

SEQ ID NO: 2034 - protein, 122 aa, Artificial Sequence
  Description of Artificial Sequence: Synthetic polypeptide
EVQLVESGGGLVQPGGSLRLSCAASGSIASIHAMGWFRQAPGKEREFVAAITWSGAITSYADSVKGRFTISADNSKNTAYLQMNSLKPEDTAVYYCAKDGGYGELHYGMEVWGQGTLVTVSS

SEQ ID NO: 2035 - protein, 113 aa, Artificial Sequence
  Description of Artificial Sequence: Synthetic polypeptide
EVQLVESGGGLVQPGGSLRLSCAASGFTPDDYAMGWFRQAPGKEREFVAAINSGGSYTYYADSVKGRFTISADNSKNTAYLQMNSLKPEDTAVYYCARDRGPWGQGTLVTVSS

SEQ ID NO: 2036 - protein, 115 aa, Artificial Sequence
  Description of Artificial Sequence: Synthetic polypeptide
EVQLVESGGGLVQPGGSLRLSCAASGGTFSVFAMGWFRQAPGKEREFVSAINWSGGSLLYADSVKGRFTISADNSKNTAYLQMNSLKPEDTAVYYCALFGDFDYWGQGTLVTVSS

SEQ ID NO: 2037 - protein, 118 aa, Artificial Sequence
  Description of Artificial Sequence: Synthetic polypeptide
EVQLVESGGGLVQPGGSLRLSCAASGPISGINRMGWFRQAPGKEREFVAVITSNGRPSYADSVKGRFTISADNSKNTAYLQMNSLKPEDTAVYYCVRLSSGYFDFDYWGQGTLVTVSS

SEQ ID NO: 2038 - protein, 117 aa, Artificial Sequence
  Description of Artificial Sequence: Synthetic polypeptide
EVQLVESGGGLVQPGGSLRLSCAASGTSIMVGAMGWFRQAPGKEREFVAIIRGDGRTSYADSVKGRFTISADNSKNTAYLQMNSLKPEDTAVYYCARFAGWDAFDIWGQGTLVTVSS

SEQ ID NO: 2039 - protein, 120 aa, Artificial Sequence
  Description of Artificial Sequence: Synthetic polypeptide
EVQLVESGGGLVQPGGSLRLSCAASGRTFSTHWMGWFRQAPGKEREFVAVINWSGGSIYYADSVKGRFTISADNSKNTAYLQMNSLKPEDTAVYYCARLSSDGYNYFDFWGQGTLVTVSS

SEQ ID NO: 2040 - protein, 115 aa, Artificial Sequence
  Description of Artificial Sequence: Synthetic polypeptide
EVQLVESGGGLVQPGGSLRLSCAASGTIFASAMGWFRQAPGKEHQFVAVVNWNGSSTVYADNVKGRFTIIADNSKNTAYLQMNSLKPEDTAVYYCTTVDQYFNYWGQGTLVTVSS

SEQ ID NO: 2041 - protein, 119 aa, Artificial Sequence
  Description of Artificial Sequence: Synthetic polypeptide
EVQLVESGGGLVQPGGSLRLSCAASGFPFSIWPMGWFRQAPGKEREFVAAVRWSSTYYADSVKGRFTISADNSKNTAYLQMNSLKPEDTAVYYCATGECDGGSCSLAYWGQGTLVTVSS

SEQ ID NO: 2042 - protein, 120 aa, Artificial Sequence
  Description of Artificial Sequence: Synthetic polypeptide
EVQLVESGGGLVQPGGSLRLSCAASGRTFGNYAMGWFRQAPGKEREFVASISSSGVSKHYADSVKGRFTISADNSKNTAYLQMNSLKPEDTAVYYCVRFGSSWARDLDQWGQGTLVTVSS

SEQ ID NO: 2043 - protein, 117 aa, Artificial Sequence
  Description of Artificial Sequence: Synthetic polypeptide
EVQLVESGGGLVQPGGSLRLSCAASGFLFDSYASMGWFRQAPGKEREFVATIWRRGNTYYANYADSVKGRFTISADNSKNTAYLQMNSLKPEDTAVYYCTETGTAAWGQGTLVTVSS

SEQ ID NO: 2044 - protein, 122 aa, Artificial Sequence
  Description of Artificial Sequence: Synthetic polypeptide
EVQLVESGGGLVQPGGSLRLSCAASGLPFSTKSMGWFRQAPGKEREFVAAISMSGLTSYADSVKGRFTISADNSKNTAYLQMNSLKPEDTAVYYCLKVLGGDYEADNWFDYWGQGTLVTVSS

SEQ ID NO: 2045 - protein, 123 aa, Artificial Sequence
  Description of Artificial Sequence: Synthetic polypeptide
EVQLVESGGGLVQPGGSLRLSCAASGNIFRIETMGWFRQAPGKEREFVAGIIRSGGETLYADSVKGRFTISADNSKNTAYLQMNSLKPEDTAVYYCARSLYYDRSGSYYFDYWGQGTLVTVSS

SEQ ID NO: 2046 - protein, 127 aa, Artificial Sequence
  Description of Artificial Sequence: Synthetic polypeptide
EVQLVESGGGLVQPGGSLRLSCAASGIPSSIRAMGWFRQAPGKEREFVAVIRWTGGSTYYADSVKGRFTISADNSKNTAYLQMNSLKPEDTAVYYCARDIGYYDSSGYYNDGGFDYWGQGTLVTVSS

SEQ ID NO: 2047 - protein, 125 aa, Artificial Sequence
  Description of Artificial Sequence: Synthetic polypeptide
EVQLVESGGGLVQPGGSLRLSCAASGFTLSGNWMGWFRQAPGKEREFVAIITSGGRTNYADSVKGRFTISADNSKNTAYLQMNSLKPEDTAVYYCAGHATFGGSSSSYYYGMDVWGQGTLVTVSS

SEQ ID NO: 2048 - protein, 117 aa, Artificial Sequence
  Description of Artificial Sequence: Synthetic polypeptide
EVQLVESGGGLVQPGGSLRLSCAASGFTFSSLAMGWFRQAPGKEREFVAAITWSGDITNYADSVKGRFTITADNSKNTAYLQMNSLKPEDTAVYYCLRLSSSGFDHWGQGTLVTVSS

SEQ ID NO: 2049 - protein, 124 aa, Artificial Sequence
  Description of Artificial Sequence: Synthetic polypeptide
EVQLVESGGGLVQPGGSLRLSCAASGTFGHYAMGWFRQAPGKEREFVAAINWSSRSTVYADSVKGRFTITADNSKNTAYLQMNSLKPEDTAVYYCAKSDGLMGELRSASAFDIWGQGTLVTVSS

SEQ ID NO: 2050 - protein, 116 aa, Artificial Sequence
  Description of Artificial Sequence: Synthetic polypeptide
EVQLVESGGGLVQPGGSLRLSCAASGIPFRSRTMGWFRQAPGKEREFVAGISRSGASTAYADSVKGRFTISADNSKNTAYLQMNSLKPEDTAVYYCTHANDYGDYWGQGTLVTVSS

SEQ ID NO: 2051 - protein, 119 aa, Artificial Sequence
  Description of Artificial Sequence: Synthetic polypeptide
EVQLVESGGGLVQPGGSLRLSCAASGGTFSTSWMGWFRQAPGKEREYVAHITAGGLSNYADSVKGRFTISADNSKNTAYLQMNSLKPEDTAVYYCARLLVREDWYFDLWGQGTLVTVSS

SEQ ID NO: 2052 - protein, 119 aa, Artificial Sequence
  Description of Artificial Sequence: Synthetic polypeptide
EVQLVESGGGLVQPGGSLRLSCAASGGTFSLFAMGWFRQAPGKEREFVAAISWTGDSTYYKYYADSVKGRFTISADNSKNTAYLQMNSLKPEDTAVYYCAYNNSSGEYWGQGTLVTVSS

SEQ ID NO: 2053 - protein, 118 aa, Artificial Sequence
  Description of Artificial Sequence: Synthetic polypeptide
EVQLVESGGGLVQPGGSLRLSCAASGSSFSAYAMGWFRQAPGKEREFVSAIDSEGTTTYADSVKGRFTISADNSKNTAYLQMNSLKPEDTAVYYCAGDYNFWSGFDHWGQGTLVTVSS

SEQ ID NO: 2054 - protein, 118 aa, Artificial Sequence
  Description of Artificial Sequence: Synthetic polypeptide
EVQLVESGGGLVQPGGSLRLSCAASGRTSSPIAMGWFRQAPGKEREPVAVRWSDDYTYYADSVKGRFTISADNSKNTAYLQMNSLKPEDTAVYYCAKKLGGYYAFDIWGQGTLVTVSS

SEQ ID NO: 2055 - protein, 115 aa, Artificial Sequence
  Description of Artificial Sequence: Synthetic polypeptide
EVQLVESGGGLVQPGGSLRLSCAASGLTFNQYTMGWFRQAPGKEREFVASITDGGSTYYADSVKGRFTISADNSKNTAYLQMNSLKPEDTAVYYCARDSRYMDVWGQGTLVTVSS

SEQ ID NO: 2056 - protein, 115 aa, Artificial Sequence
  Description of Artificial Sequence: Synthetic polypeptide
EVQLVESGGGLVQPGGSLRLSCAASGPTFSSMGWFRQAPGKEREFVAAISWDGGATAYADSVKGRFTISADNSKNTAYLQMNSLKPEDTAVYYCAIEIVVGGIYWGQGTLVTVSS

SEQ ID NO: 2057 - protein, 116 aa, Artificial Sequence
  Description of Artificial Sequence: Synthetic polypeptide
EVQLVESGGGLVQPGGSLRLSCAASGIPSTLRAMGWFRQAPGKEREFVAATSWSGGSKYYADSVKGRFTISADNSKNTAYLQMNSLKPEDTAVYYCATDLYYMDVWGQGTLVTVSS

SEQ ID NO: 2058 - protein, 119 aa, Artificial Sequence
  Description of Artificial Sequence: Synthetic polypeptide
EVQLVESGGGLVQPGGSLRLSCAASGGVGFSVTNMGWFRQAPGKEREFVAVISSSSSTNYADSVKGRFTISADNSKNTAYLQMNSLKPEDTAVYYCTTFNWNDEGFDYWGQGTLVTVSS

SEQ ID NO: 2059 - protein, 125 aa, Artificial Sequence
  Description of Artificial Sequence: Synthetic polypeptide
EVQLVESGGGLVQPGGSLRLSCAASGGTFGSYGMGWFRQAPGKEREFVAAIRWSGGITYYADSVKGRFTISADNSKNTAYLQMNSLKPEDTAVYYCARERYWNPLPYYYYGMDVWGQGTLVTVSS

SEQ ID NO: 2060 - protein, 128 aa, Artificial Sequence
  Description of Artificial Sequence: Synthetic polypeptide
EVQLVESGGGLVQPGGSLRLSCAASGGTFSTYAMGWFRQVPGKEREFVASIDWSGLTSYADSVKGRFTISADNSKNTAYLQMNSLKPEDTAVYYCARGPFYMYCSGTKCYSTNWFDPWGQGTLVTVSS

SEQ ID NO: 2061 - protein, 122 aa, Artificial Sequence
  Description of Artificial Sequence: Synthetic polypeptide
EVQLVESGGGLVQPGGSLRLSCAASGPIYAVNRMGWFRQAPGKEREFVAGIWRSGGHRDYADSVKGRFTISADNSKNTAYLQMNSLKPEDTAVYYCARGEIDILTGYWYDYWGQGTLVTVSS

SEQ ID NO: 2062 - protein, 126 aa, Artificial Sequence
  Description of Artificial Sequence: Synthetic polypeptide
EVQLVESGGGLVQPGGSLRLSCAASGFTFSNYWMGWFRQAPGKEREFVGGISRSGVSTSYADSVKGRFTISADNSKNTAYLQMNSLKPEDTAVYYCTTLLYYYDSSGYSFDAFDIWGQGTLVTVSS

SEQ ID NO: 2063 - protein, 125 aa, Artificial Sequence
  Description of Artificial Sequence: Synthetic polypeptide
EVQLVESGGGLVQPGGSLRLSCAASGGTFSAYHMGWFRQAPGKERELVTIIDNGGPTSYADSVKGRFTISADNSKNTAYLQMNSLKPEDTAVYYCTALLYYFDNSGYNFDPFDIWGQGTLVTGSS

SEQ ID NO: 2064 - protein, 126 aa, Artificial Sequence; identical to SEQ ID NO: 493
  Description of Artificial Sequence: Synthetic polypeptide

SEQ ID NO: 2065 - protein, 122 aa, Artificial Sequence; identical to SEQ ID NO: 494
  Description of Artificial Sequence: Synthetic polypeptide

SEQ ID NO: 2066 - protein, 122 aa, Artificial Sequence; identical to SEQ ID NO: 495
  Description of Artificial Sequence: Synthetic polypeptide

SEQ ID NO: 2067 - protein, 129 aa, Artificial Sequence; identical to SEQ ID NO: 496
  Description of Artificial Sequence: Synthetic polypeptide

SEQ ID NO: 2068 - protein, 122 aa, Artificial Sequence
  Description of Artificial Sequence: Synthetic polypeptide
EVQLLESGGGLVQPGGSLRLSCAASGFTFSDFAMAWVRQAPGKGLEWVSAISGSGDITYYADSVKGRFTISRDNSKNTLYLQMNSLRAEDTAVYYCAREADCLPSPWYLDLWGQGTLVTVSS

SEQ ID NO: 2069 - protein, 122 aa, Artificial Sequence; identical to SEQ ID NO: 495
  Description of Artificial Sequence: Synthetic polypeptide

SEQ ID NO: 2070 - protein, 117 aa, Artificial Sequence; identical to SEQ ID NO: 498
  Description of Artificial Sequence: Synthetic polypeptide

SEQ ID NO: 2071 - protein, 122 aa, Artificial Sequence; identical to SEQ ID NO: 499
  Description of Artificial Sequence: Synthetic polypeptide

SEQ ID NO: 2072 - protein, 117 aa, Artificial Sequence; identical to SEQ ID NO: 500
  Description of Artificial Sequence: Synthetic polypeptide

SEQ ID NO: 2073 - protein, 117 aa, Artificial Sequence; identical to SEQ ID NO: 501
  Description of Artificial Sequence: Synthetic polypeptide

SEQ ID NO: 2074 - protein, 117 aa, Artificial Sequence; identical to SEQ ID NO: 502
  Description of Artificial Sequence: Synthetic polypeptide

SEQ ID NO: 2075 - protein, 117 aa, Artificial Sequence; identical to SEQ ID NO: 503
  Description of Artificial Sequence: Synthetic polypeptide

SEQ ID NO: 2076 - protein, 122 aa, Artificial Sequence; identical to SEQ ID NO: 495
  Description of Artificial Sequence: Synthetic polypeptide

SEQ ID NO: 2077 - protein, 122 aa, Artificial Sequence; identical to SEQ ID NO: 495
  Description of Artificial Sequence: Synthetic polypeptide

SEQ ID NO: 2078 - protein, 116 aa, Artificial Sequence; identical to SEQ ID NO: 506
  Description of Artificial Sequence: Synthetic polypeptide

SEQ ID NO: 2079 - protein, 107 aa, Artificial Sequence; identical to SEQ ID NO: 520
  Description of Artificial Sequence: Synthetic polypeptide

SEQ ID NO: 2080 - protein, 108 aa, Artificial Sequence; identical to SEQ ID NO: 521
  Description of Artificial Sequence: Synthetic polypeptide

SEQ ID NO: 2081 - protein, 108 aa, Artificial Sequence; identical to SEQ ID NO: 522
  Description of Artificial Sequence: Synthetic polypeptide

SEQ ID NO: 2082 - protein, 106 aa, Artificial Sequence; identical to SEQ ID NO: 523
  Description of Artificial Sequence: Synthetic polypeptide

SEQ ID NO: 2083 - protein, 108 aa, Artificial Sequence
  Description of Artificial Sequence: Synthetic polypeptide
DIQMTQSPSSLSASVGDRVTITCRASQNIHTYLNWYQQKPGKAPKLLIYAASTFAKGVPSRFSGSGSGTDFTLTISSLQPEDFATYYCQQSYSAPPYTFGQGTKVEIK

SEQ ID NO: 2084 - protein, 108 aa, Artificial Sequence; identical to SEQ ID NO: 524
  Description of Artificial Sequence: Synthetic polypeptide

SEQ ID NO: 2085 - protein, 107 aa, Artificial Sequence; identical to SEQ ID NO: 526
  Description of Artificial Sequence: Synthetic polypeptide

SEQ ID NO: 2086 - protein, 108 aa, Artificial Sequence; identical to SEQ ID NO: 524
  Description of Artificial Sequence: Synthetic polypeptide

SEQ ID NO: 2087 - protein, 108 aa, Artificial Sequence; identical to SEQ ID NO: 527
  Description of Artificial Sequence: Synthetic polypeptide

SEQ ID NO: 2088 - protein, 108 aa, Artificial Sequence; identical to SEQ ID NO: 528
  Description of Artificial Sequence: Synthetic polypeptide

SEQ ID NO: 2089 - protein, 108 aa, Artificial Sequence; identical to SEQ ID NO: 524
  Description of Artificial Sequence: Synthetic polypeptide

SEQ ID NO: 2090 - protein, 108 aa, Artificial Sequence; identical to SEQ ID NO: 529
  Description of Artificial Sequence: Synthetic polypeptide

SEQ ID NO: 2091 - protein, 108 aa, Artificial Sequence; identical to SEQ ID NO: 524
  Description of Artificial Sequence: Synthetic polypeptide

SEQ ID NO: 2092 - protein, 107 aa, Artificial Sequence; identical to SEQ ID NO: 532
  Description of Artificial Sequence: Synthetic polypeptide

SEQ ID NO: 2093 - protein, 107 aa, Artificial Sequence; identical to SEQ ID NO: 533
  Description of Artificial Sequence: Synthetic polypeptide

SEQ ID NO: 2094 - protein, 121 aa, Artificial Sequence; identical to SEQ ID NO: 507
  Description of Artificial Sequence: Synthetic polypeptide

SEQ ID NO: 2095 - protein, 123 aa, Artificial Sequence; identical to SEQ ID NO: 508
  Description of Artificial Sequence: Synthetic polypeptide

SEQ ID NO: 2096 - protein, 123 aa, Artificial Sequence; identical to SEQ ID NO: 509
  Description of Artificial Sequence: Synthetic polypeptide

SEQ ID NO: 2097 - protein, 121 aa, Artificial Sequence; identical to SEQ ID NO: 510
  Description of Artificial Sequence: Synthetic polypeptide

SEQ ID NO: 2098 - protein, 119 aa, Artificial Sequence; identical to SEQ ID NO: 511
  Description of Artificial Sequence: Synthetic polypeptide

SEQ ID NO: 2099 - protein, 110 aa, Artificial Sequence; identical to SEQ ID NO: 534
  Description of Artificial Sequence: Synthetic polypeptide

SEQ ID NO: 2100 - protein, 110 aa, Artificial Sequence; identical to SEQ ID NO: 535
  Description of Artificial Sequence: Synthetic polypeptide

SEQ ID NO: 2101 - protein, 111 aa, Artificial Sequence; identical to SEQ ID NO: 536
  Description of Artificial Sequence: Synthetic polypeptide

SEQ ID NO: 2102 - protein, 112 aa, Artificial Sequence; identical to SEQ ID NO: 537
  Description of Artificial Sequence: Synthetic polypeptide

SEQ ID NO: 2103 - protein, 112 aa, Artificial Sequence; identical to SEQ ID NO: 538
  Description of Artificial Sequence: Synthetic polypeptide

SEQ ID NO: 2104 - protein, 126 aa, Artificial Sequence; identical to SEQ ID NO: 721
  Description of Artificial Sequence: Synthetic polypeptide

SEQ ID NO: 2105 - protein, 121 aa, Artificial Sequence; identical to SEQ ID NO: 722
  Description of Artificial Sequence: Synthetic polypeptide

SEQ ID NO: 2106 - protein, 123 aa, Artificial Sequence; identical to SEQ ID NO: 723
  Description of Artificial Sequence: Synthetic polypeptide

SEQ ID NO: 2107 - protein, 122 aa, Artificial Sequence; identical to SEQ ID NO: 724
  Description of Artificial Sequence: Synthetic polypeptide

SEQ ID NO: 2108 - protein, 121 aa, Artificial Sequence; identical to SEQ ID NO: 725
  Description of Artificial Sequence: Synthetic polypeptide

SEQ ID NO: 2109 - protein, 122 aa, Artificial Sequence; identical to SEQ ID NO: 726
  Description of Artificial Sequence: Synthetic polypeptide

SEQ ID NO: 2110 - protein, 126 aa, Artificial Sequence; identical to SEQ ID NO: 727
  Description of Artificial Sequence: Synthetic polypeptide

SEQ ID NO: 2111 - protein, 121 aa, Artificial Sequence; identical to SEQ ID NO: 728
  Description of Artificial Sequence: Synthetic polypeptide

SEQ ID NO: 2112 - protein, 121 aa, Artificial Sequence; identical to SEQ ID NO: 729
  Description of Artificial Sequence: Synthetic polypeptide

SEQ ID NO: 2113 - protein, 126 aa, Artificial Sequence; identical to SEQ ID NO: 721
  Description of Artificial Sequence: Synthetic polypeptide

SEQ ID NO: 2114 - protein, 121 aa, Artificial Sequence; identical to SEQ ID NO: 731
  Description of Artificial Sequence: Synthetic polypeptide

SEQ ID NO: 2115 - protein, 123 aa, Artificial Sequence; identical to SEQ ID NO: 732
  Description of Artificial Sequence: Synthetic polypeptide

SEQ ID NO: 2116 - protein, 126 aa, Artificial Sequence; identical to SEQ ID NO: 721
  Description of Artificial Sequence: Synthetic polypeptide

SEQ ID NO: 2117 - protein, 126 aa, Artificial Sequence; identical to SEQ ID NO: 734
  Description of Artificial Sequence: Synthetic polypeptide

SEQ ID NO: 2118 - protein, 121 aa, Artificial Sequence; identical to SEQ ID NO: 735
  Description of Artificial Sequence: Synthetic polypeptide

SEQ ID NO: 2119 - protein, 107 aa, Artificial Sequence
  Description of Artificial Sequence: Synthetic polypeptide
DIQMTQSPSSLSASVGDRVTITCRASQSIRKYLNWYQQKPGKAPKLLIYASSTLQRGVPSRFSGSGSGTDFTLTISSLQPEDFATYYCQQSLSTPFTFGQGTKVEIK

SEQ ID NO: 2120 - protein, 107 aa, Artificial Sequence; identical to SEQ ID NO: 756
  Description of Artificial Sequence: Synthetic polypeptide

SEQ ID NO: 2121 - protein, 103 aa, Artificial Sequence; identical to SEQ ID NO: 753
  Description of Artificial Sequence: Synthetic polypeptide

SEQ ID NO: 2122 - protein, 107 aa, Artificial Sequence; identical to SEQ ID NO: 751
  Description of Artificial Sequence: Synthetic polypeptide

SEQ ID NO: 2123 - protein, 107 aa, Artificial Sequence; identical to SEQ ID NO: 755
  Description of Artificial Sequence: Synthetic polypeptide

SEQ ID NO: 2124 - protein, 107 aa, Artificial Sequence; identical to SEQ ID NO: 757
  Description of Artificial Sequence: Synthetic polypeptide

SEQ ID NO: 2125 - protein, 107 aa, Artificial Sequence; identical to SEQ ID NO: 758
  Description of Artificial Sequence: Synthetic polypeptide

SEQ ID NO: 2126 - protein, 107 aa, Artificial Sequence; identical to SEQ ID NO: 752
  Description of Artificial Sequence: Synthetic polypeptide

SEQ ID NO: 2127 - protein, 107 aa, Artificial Sequence; identical to SEQ ID NO: 754
  Description of Artificial Sequence: Synthetic polypeptide

SEQ ID NO: 2128 - protein, 107 aa, Artificial Sequence; identical to SEQ ID NO: 761
  Description of Artificial Sequence: Synthetic polypeptide

SEQ ID NO: 2129 - protein, 107 aa, Artificial Sequence; identical to SEQ ID NO: 759
  Description of Artificial Sequence: Synthetic polypeptide

SEQ ID NO: 2130 - protein, 107 aa, Artificial Sequence; identical to SEQ ID NO: 760
  Description of Artificial Sequence: Synthetic polypeptide

SEQ ID NO: 2131 - protein, 107 aa, Artificial Sequence; identical to SEQ ID NO: 764
  Description of Artificial Sequence: Synthetic polypeptide

SEQ ID NO: 2132 - protein, 107 aa, Artificial Sequence; identical to SEQ ID NO: 762
  Description of Artificial Sequence: Synthetic polypeptide

SEQ ID NO: 2133 - protein, 107 aa, Artificial Sequence; identical to SEQ ID NO: 754
  Description of Artificial Sequence: Synthetic polypeptide

SEQ ID NO: 2134 - protein, 123 aa, Artificial Sequence; identical to SEQ ID NO: 736
  Description of Artificial Sequence: Synthetic polypeptide

SEQ ID NO: 2135 - protein, 120 aa, Artificial Sequence; identical to SEQ ID NO: 737
  Description of Artificial Sequence: Synthetic polypeptide

SEQ ID NO: 2136 - protein, 117 aa, Artificial Sequence; identical to SEQ ID NO: 738
  Description of Artificial Sequence: Synthetic polypeptide

SEQ ID NO: 2137 - protein, 119 aa, Artificial Sequence; identical to SEQ ID NO: 739
  Description of Artificial Sequence: Synthetic polypeptide

SEQ ID NO: 2138 - protein, 124 aa, Artificial Sequence; identical to SEQ ID NO: 740
  Description of Artificial Sequence: Synthetic polypeptide

SEQ ID NO: 2139 - protein, 118 aa, Artificial Sequence; identical to SEQ ID NO: 741
  Description of Artificial Sequence: Synthetic polypeptide

SEQ ID NO: 2140 - protein, 120 aa, Artificial Sequence; identical to SEQ ID NO: 742
  Description of Artificial Sequence: Synthetic polypeptide

SEQ ID NO: 2141 - protein, 117 aa, Artificial Sequence; identical to SEQ ID NO: 743
  Description of Artificial Sequence: Synthetic polypeptide

SEQ ID NO: 2142 - protein, 123 aa, Artificial Sequence; identical to SEQ ID NO: 744
  Description of Artificial Sequence: Synthetic polypeptide

SEQ ID NO: 2143 - protein, 123 aa, Artificial Sequence; identical to SEQ ID NO: 745
  Description of Artificial Sequence: Synthetic polypeptide

SEQ ID NO: 2144 - protein, 126 aa, Artificial Sequence; identical to SEQ ID NO: 746
  Description of Artificial Sequence: Synthetic polypeptide

SEQ ID NO: 2145 - protein, 121 aa, Artificial Sequence; identical to SEQ ID NO: 747
  Description of Artificial Sequence: Synthetic polypeptide

SEQ ID NO: 2146 - protein, 125 aa, Artificial Sequence; identical to SEQ ID NO: 748
  Description of Artificial Sequence: Synthetic polypeptide

SEQ ID NO: 2147 - protein, 130 aa, Artificial Sequence; identical to SEQ ID NO: 749
  Description of Artificial Sequence: Synthetic polypeptide

SEQ ID NO: 2148 - protein, 107 aa, Artificial Sequence; identical to SEQ ID NO: 765
  Description of Artificial Sequence: Synthetic polypeptide

SEQ ID NO: 2149 - protein, 107 aa, Artificial Sequence; identical to SEQ ID NO: 766
  Description of Artificial Sequence: Synthetic polypeptide

SEQ ID NO: 2150 - protein, 107 aa, Artificial Sequence; identical to SEQ ID NO: 767
  Description of Artificial Sequence: Synthetic polypeptide

SEQ ID NO: 2151 - protein, 107 aa, Artificial Sequence; identical to SEQ ID NO: 768
  Description of Artificial Sequence: Synthetic polypeptide

SEQ ID NO: 2152 - protein, 107 aa, Artificial Sequence; identical to SEQ ID NO: 769
  Description of Artificial Sequence: Synthetic polypeptide

SEQ ID NO: 2153 - protein, 107 aa, Artificial Sequence; identical to SEQ ID NO: 770
  Description of Artificial Sequence: Synthetic polypeptide

SEQ ID NO: 2154 - protein, 107 aa, Artificial Sequence; identical to SEQ ID NO: 771
  Description of Artificial Sequence: Synthetic polypeptide

SEQ ID NO: 2155 - protein, 107 aa, Artificial Sequence; identical to SEQ ID NO: 772
  Description of Artificial Sequence: Synthetic polypeptide

SEQ ID NO: 2156 - protein, 107 aa, Artificial Sequence; identical to SEQ ID NO: 773
  Description of Artificial Sequence: Synthetic polypeptide

SEQ ID NO: 2157 - protein, 107 aa, Artificial Sequence; identical to SEQ ID NO: 774
  Description of Artificial Sequence: Synthetic polypeptide

SEQ ID NO: 2158 - protein, 107 aa, Artificial Sequence; identical to SEQ ID NO: 775
  Description of Artificial Sequence: Synthetic polypeptide

SEQ ID NO: 2159 - protein, 107 aa, Artificial Sequence; identical to SEQ ID NO: 776
  Description of Artificial Sequence: Synthetic polypeptide

SEQ ID NO: 2160 - protein, 107 aa, Artificial Sequence; identical to SEQ ID NO: 777
  Description of Artificial Sequence: Synthetic polypeptide

SEQ ID NO: 2161 - protein, 107 aa, Artificial Sequence; identical to SEQ ID NO: 778
  Description of Artificial Sequence: Synthetic polypeptide

SEQ ID NO: 2162 - protein, 116 aa, Artificial Sequence; identical to SEQ ID NO: 1203
  Description of Artificial Sequence: Synthetic polypeptide

SEQ ID NO: 2163 - protein, 116 aa, Artificial Sequence; identical to SEQ ID NO: 1204
  Description of Artificial Sequence: Synthetic polypeptide

SEQ ID NO: 2164 - protein, 114 aa, Artificial Sequence; identical to SEQ ID NO: 1205
  Description of Artificial Sequence: Synthetic polypeptide

SEQ ID NO: 2165 - protein, 116 aa, Artificial Sequence; identical to SEQ ID NO: 1206
  Description of Artificial Sequence: Synthetic polypeptide

SEQ ID NO: 2166 - protein, 120 aa, Artificial Sequence; identical to SEQ ID NO: 1207
  Description of Artificial Sequence: Synthetic polypeptide

SEQ ID NO: 2167 - protein, 118 aa, Artificial Sequence; identical to SEQ ID NO: 1208
  Description of Artificial Sequence: Synthetic polypeptide

SEQ ID NO: 2168 - protein, 116 aa, Artificial Sequence; identical to SEQ ID NO: 1209
  Description of Artificial Sequence: Synthetic polypeptide

SEQ ID NO: 2169 - protein, 120 aa, Artificial Sequence; identical to SEQ ID NO: 1210
  Description of Artificial Sequence: Synthetic polypeptide

SEQ ID NO: 2170 - protein, 125 aa, Artificial Sequence; identical to SEQ ID NO: 1211
  Description of Artificial Sequence: Synthetic polypeptide

SEQ ID NO: 2171 - protein, 121 aa, Artificial Sequence; identical to SEQ ID NO: 1212
  Description of Artificial Sequence: Synthetic polypeptide

SEQ ID NO: 2172 - protein, 117 aa, Artificial Sequence; identical to SEQ ID NO: 1213
  Description of Artificial Sequence: Synthetic polypeptide

SEQ ID NO: 2173 - protein, 123 aa, Artificial Sequence; identical to SEQ ID NO: 1214
  Description of Artificial Sequence: Synthetic polypeptide

SEQ ID NO: 2174 - protein, 120 aa, Artificial Sequence; identical to SEQ ID NO: 1215
  Description of Artificial Sequence: Synthetic polypeptide

SEQ ID NO: 2175 - protein, 120 aa, Artificial Sequence; identical to SEQ ID NO: 1216
  Description of Artificial Sequence: Synthetic polypeptide

SEQ ID NO: 2176 - protein, 120 aa, Artificial Sequence; identical to SEQ ID NO: 1217
  Description of Artificial Sequence: Synthetic polypeptide

SEQ ID NO: 2177 - protein, 120 aa, Artificial Sequence; identical to SEQ ID NO: 1218
  Description of Artificial Sequence: Synthetic polypeptide

SEQ ID NO: 2178 - protein, 114 aa, Artificial Sequence; identical to SEQ ID NO: 1219
  Description of Artificial Sequence: Synthetic polypeptide

SEQ ID NO: 2179 - protein, 114 aa, Artificial Sequence; identical to SEQ ID NO: 1220
  Description of Artificial Sequence: Synthetic polypeptide

SEQ ID NO: 2180 - protein, 114 aa, Artificial Sequence; identical to SEQ ID NO: 1221
  Description of Artificial Sequence: Synthetic polypeptide

SEQ ID NO: 2181 - protein, 114 aa, Artificial Sequence; identical to SEQ ID NO: 1222
  Description of Artificial Sequence: Synthetic polypeptide

SEQ ID NO: 2182 - protein, 114 aa, Artificial Sequence; identical to SEQ ID NO: 1223
  Description of Artificial Sequence: Synthetic polypeptide

SEQ ID NO: 2183 - protein, 128 aa, Artificial Sequence; identical to SEQ ID NO: 1224
  Description of Artificial Sequence: Synthetic polypeptide

SEQ ID NO: 2184 - protein, 114 aa, Artificial Sequence; identical to SEQ ID NO: 1225
  Description of Artificial Sequence: Synthetic polypeptide

SEQ ID NO: 2185 - protein, 114 aa, Artificial Sequence; identical to SEQ ID NO: 1226
  Description of Artificial Sequence: Synthetic polypeptide

SEQ ID NO: 2186 - protein, 120 aa, Artificial Sequence; identical to SEQ ID NO: 1227
  Description of Artificial Sequence: Synthetic polypeptide

SEQ ID NO: 2187 - protein, 124 aa, Artificial Sequence; identical to SEQ ID NO: 1228
  Description of Artificial Sequence: Synthetic polypeptide

SEQ ID NO: 2188 - protein, 120 aa, Artificial Sequence; identical to SEQ ID NO: 1229
  Description of Artificial Sequence: Synthetic polypeptide

SEQ ID NO: 2189 - protein, 120 aa, Artificial Sequence; identical to SEQ ID NO: 1230
  Description of Artificial Sequence: Synthetic polypeptide

SEQ ID NO: 2190 - protein, 120 aa, Artificial Sequence; identical to SEQ ID NO: 1231
  Description of Artificial Sequence: Synthetic polypeptide

SEQ ID NO: 2191 - protein, 114 aa, Artificial Sequence; identical to SEQ ID NO: 1232
  Description of Artificial Sequence: Synthetic polypeptide

SEQ ID NO: 2192 - protein, 114 aa, Artificial Sequence; identical to SEQ ID NO: 1233
  Description of Artificial Sequence: Synthetic polypeptide

SEQ ID NO: 2193 - protein, 114 aa, Artificial Sequence; identical to SEQ ID NO: 1234
  Description of Artificial Sequence: Synthetic polypeptide

SEQ ID NO: 2194 - protein, 114 aa, Artificial Sequence; identical to SEQ ID NO: 1235
  Description of Artificial Sequence: Synthetic polypeptide

SEQ ID NO: 2195 - protein, 114 aa, Artificial Sequence; identical to SEQ ID NO: 1236
  Description of Artificial Sequence: Synthetic polypeptide

SEQ ID NO: 2196 - protein, 114 aa, Artificial Sequence; identical to SEQ ID NO: 1237
  Description of Artificial Sequence: Synthetic polypeptide

SEQ ID NO: 2197 - protein, 114 aa, Artificial Sequence; identical to SEQ ID NO: 1238
  Description of Artificial Sequence: Synthetic polypeptide

SEQ ID NO: 2198 - protein, 114 aa, Artificial Sequence; identical to SEQ ID NO: 1239
  Description of Artificial Sequence: Synthetic polypeptide

SEQ ID NO: 2199 - protein, 120 aa, Artificial Sequence; identical to SEQ ID NO: 1240
  Description of Artificial Sequence: Synthetic polypeptide

SEQ ID NO: 2200 - protein, 114 aa, Artificial Sequence; identical to SEQ ID NO: 1241
  Description of Artificial Sequence: Synthetic polypeptide

SEQ ID NO: 2201 - protein, 114 aa, Artificial Sequence; identical to SEQ ID NO: 1242
  Description of Artificial Sequence: Synthetic polypeptide

SEQ ID NO: 2202 - protein, 123 aa, Artificial Sequence; identical to SEQ ID NO: 1243
  Description of Artificial Sequence: Synthetic polypeptide

SEQ ID NO: 2203 - protein, 120 aa, Artificial Sequence; identical to SEQ ID NO: 1244
  Description of Artificial Sequence: Synthetic polypeptide

SEQ ID NO: 2204 - protein, 114 aa, Artificial Sequence; identical to SEQ ID NO: 1245
  Description of Artificial Sequence: Synthetic polypeptide

SEQ ID NO: 2205 - protein, 128 aa, Artificial Sequence; identical to SEQ ID NO: 1246
  Description of Artificial Sequence: Synthetic polypeptide

SEQ ID NO: 2206 - protein, 120 aa, Artificial Sequence; identical to SEQ ID NO: 1247
  Description of Artificial Sequence: Synthetic polypeptide

SEQ ID NO: 2207 - protein, 114 aa, Artificial Sequence; identical to SEQ ID NO: 1248
  Description of Artificial Sequence: Synthetic polypeptide

SEQ ID NO: 2208 - protein, 114 aa, Artificial Sequence; identical to SEQ ID NO: 1249
  Description of Artificial Sequence: Synthetic polypeptide

SEQ ID NO: 2209 - protein, 120 aa, Artificial Sequence; identical to SEQ ID NO: 1250
  Description of Artificial Sequence: Synthetic polypeptide

SEQ ID NO: 2210 - protein, 114 aa, Artificial Sequence; identical to SEQ ID NO: 1251
  Description of Artificial Sequence: Synthetic polypeptide

SEQ ID NO: 2211 - protein, 114 aa, Artificial Sequence; identical to SEQ ID NO: 1252
  Description of Artificial Sequence: Synthetic polypeptide

SEQ ID NO: 2212 - protein, 114 aa, Artificial Sequence; identical to SEQ ID NO: 1253
  Description of Artificial Sequence: Synthetic polypeptide

SEQ ID NO: 2213 - protein, 114 aa, Artificial Sequence; identical to SEQ ID NO: 1254
  Description of Artificial Sequence: Synthetic polypeptide

SEQ ID NO: 2214 - protein, 118 aa, Artificial Sequence; identical to SEQ ID NO: 1255
  Description of Artificial Sequence: Synthetic polypeptide

SEQ ID NO: 2215 - protein, 118 aa, Artificial Sequence; identical to SEQ ID NO: 1256
  Description of Artificial Sequence: Synthetic polypeptide

SEQ ID NO: 2216 - protein, 114 aa, Artificial Sequence; identical to SEQ ID NO: 1257
  Description of Artificial Sequence: Synthetic polypeptide

SEQ ID NO: 2217 - protein, 120 aa, Artificial Sequence; identical to SEQ ID NO: 1258
  Description of Artificial Sequence: Synthetic polypeptide

SEQ ID NO: 2218 - protein, 114 aa, Artificial Sequence; identical to SEQ ID NO: 1259
  Description of Artificial Sequence: Synthetic polypeptide

SEQ ID NO: 2219 - protein, 114 aa, Artificial Sequence; identical to SEQ ID NO: 1260
  Description of Artificial Sequence: Synthetic polypeptide

SEQ ID NO: 2220 - protein, 114 aa, Artificial Sequence; identical to SEQ ID NO: 1261
  Description of Artificial Sequence: Synthetic polypeptide

SEQ ID NO: 2221 - protein, 114 aa, Artificial Sequence; identical to SEQ ID NO: 1262
  Description of Artificial Sequence: Synthetic polypeptide

SEQ ID NO: 2222 - protein, 114 aa, Artificial Sequence; identical to SEQ ID NO: 1263
  Description of Artificial Sequence: Synthetic polypeptide

SEQ ID NO: 2223 - protein, 114 aa, Artificial Sequence; identical to SEQ ID NO: 1264
  Description of Artificial Sequence: Synthetic polypeptide

SEQ ID NO: 2224 - protein, 114 aa, Artificial Sequence; identical to SEQ ID NO: 1265
  Description of Artificial Sequence: Synthetic polypeptide

SEQ ID NO: 2225 - protein, 120 aa, Artificial Sequence; identical to SEQ ID NO: 1266
  Description of Artificial Sequence: Synthetic polypeptide

SEQ ID NO: 2226 - protein, 114 aa, Artificial Sequence; identical to SEQ ID NO: 1267
  Description of Artificial Sequence: Synthetic polypeptide

SEQ ID NO: 2227 - protein, 114 aa, Artificial Sequence; identical to SEQ ID NO: 1268
  Description of Artificial Sequence: Synthetic polypeptide

SEQ ID NO: 2228 - protein, 120 aa, Artificial Sequence; identical to SEQ ID NO: 1269
  Description of Artificial Sequence: Synthetic polypeptide

SEQ ID NO: 2229 - protein, 114 aa, Artificial Sequence; identical to SEQ ID NO: 1270
  Description of Artificial Sequence: Synthetic polypeptide

SEQ ID NO: 2230 - protein, 114 aa, Artificial Sequence; identical to SEQ ID NO: 1271
  Description of Artificial Sequence: Synthetic polypeptide

SEQ ID NO: 2231 - protein, 114 aa, Artificial Sequence; identical to SEQ ID NO: 1272
  Description of Artificial Sequence: Synthetic polypeptide

SEQ ID NO: 2232 - protein, 118 aa, Artificial Sequence; identical to SEQ ID NO: 1273
  Description of Artificial Sequence: Synthetic polypeptide

SEQ ID NO: 2233 - protein, 114 aa, Artificial Sequence; identical to SEQ ID NO: 1274
  Description of Artificial Sequence: Synthetic polypeptide

SEQ ID NO: 2234 - protein, 114 aa, Artificial Sequence; identical to SEQ ID NO: 1275
  Description of Artificial Sequence: Synthetic polypeptide

SEQ ID NO: 2235 - protein, 114 aa, Artificial Sequence; identical to SEQ ID NO: 1276
  Description of Artificial Sequence: Synthetic polypeptide

SEQ ID NO: 2236 - protein, 114 aa, Artificial Sequence; identical to SEQ ID NO: 1277
  Description of Artificial Sequence: Synthetic polypeptide

SEQ ID NO: 2237 - protein, 120 aa, Artificial Sequence; identical to SEQ ID NO: 1278
  Description of Artificial Sequence: Synthetic polypeptide

SEQ ID NO: 2238 - protein, 114 aa, Artificial Sequence; identical to SEQ ID NO: 1279
  Description of Artificial Sequence: Synthetic polypeptide

SEQ ID NO: 2239 - protein, 120 aa, Artificial Sequence; identical to SEQ ID NO: 1280
  Description of Artificial Sequence: Synthetic polypeptide

SEQ ID NO: 2240 - protein, 114 aa, Artificial Sequence; identical to SEQ ID NO: 1281
  Description of Artificial Sequence: Synthetic polypeptide

SEQ ID NO: 2241 - protein, 114 aa, Artificial Sequence; identical to SEQ ID NO: 1282
  Description of Artificial Sequence: Synthetic polypeptide

SEQ ID NO: 2242 - protein, 120 aa, Artificial Sequence; identical to SEQ ID NO: 1283
  Description of Artificial Sequence: Synthetic polypeptide

SEQ ID NO: 2243 - protein, 120 aa, Artificial Sequence; identical to SEQ ID NO: 1284
  Description of Artificial Sequence: Synthetic polypeptide

SEQ ID NO: 2244 - protein, 114 aa, Artificial Sequence; identical to SEQ ID NO: 1285
  Description of Artificial Sequence: Synthetic polypeptide

SEQ ID NO: 2245 - protein, 120 aa, Artificial Sequence; identical to SEQ ID NO: 1286
  Description of Artificial Sequence: Synthetic polypeptide

SEQ ID NO: 2246 - protein, 114 aa, Artificial Sequence; identical to SEQ ID NO: 1287
  Description of Artificial Sequence: Synthetic polypeptide

SEQ ID NO: 2247 - protein, 120 aa, Artificial Sequence; identical to SEQ ID NO: 1288
  Description of Artificial Sequence: Synthetic polypeptide

SEQ ID NO: 2248 - protein, 120 aa, Artificial Sequence; identical to SEQ ID NO: 1289
  Description of Artificial Sequence: Synthetic polypeptide

SEQ ID NO: 2249 - protein, 123 aa, Artificial Sequence; identical to SEQ ID NO: 1290
  Description of Artificial Sequence: Synthetic polypeptide

SEQ ID NO: 2250 - protein, 122 aa, Artificial Sequence; identical to SEQ ID NO: 1291
  Description of Artificial Sequence: Synthetic polypeptide

SEQ ID NO: 2251 - protein, 124 aa, Artificial Sequence; identical to SEQ ID NO: 1292
  Description of Artificial Sequence: Synthetic polypeptide

SEQ ID NO: 2252 - protein, 116 aa, Artificial Sequence; identical to SEQ ID NO: 1293
  Description of Artificial Sequence: Synthetic polypeptide

SEQ ID NO: 2253 - protein, 120 aa, Artificial Sequence; identical to SEQ ID NO: 1294
  Description of Artificial Sequence: Synthetic polypeptide

SEQ ID NO: 2254 - protein, 124 aa, Artificial Sequence; identical to SEQ ID NO: 1295
  Description of Artificial Sequence: Synthetic polypeptide

SEQ ID NO: 2255 - protein, 114 aa, Artificial Sequence; identical to SEQ ID NO: 1296
  Description of Artificial Sequence: Synthetic polypeptide

SEQ ID NO: 2256 - protein, 119 aa, Artificial Sequence; identical to SEQ ID NO: 1297
  Description of Artificial Sequence: Synthetic polypeptide

SEQ ID NO: 2257 - protein, 123 aa, Artificial Sequence; identical to SEQ ID NO: 1298
  Description of Artificial Sequence: Synthetic polypeptide

SEQ ID NO: 2258 - protein, 122 aa, Artificial Sequence; identical to SEQ ID NO: 1299
  Description of Artificial Sequence: Synthetic polypeptide

SEQ ID NO: 2259 - protein, 124 aa, Artificial Sequence; identical to SEQ ID NO: 1300
  Description of Artificial Sequence: Synthetic polypeptide

SEQ ID NO: 2260 - protein, 124 aa, Artificial Sequence; identical to SEQ ID NO: 1301
  Description of Artificial Sequence: Synthetic polypeptide

SEQ ID NO: 2261 - protein, 126 aa, Artificial Sequence; identical to SEQ ID NO: 1302
  Description of Artificial Sequence: Synthetic polypeptide

SEQ ID NO: 2262 - protein, 118 aa, Artificial Sequence; identical to SEQ ID NO: 1303
  Description of Artificial Sequence: Synthetic polypeptide

SEQ ID NO: 2263 - protein, 124 aa, Artificial Sequence; identical to SEQ ID NO: 1304
  Description of Artificial Sequence: Synthetic polypeptide

SEQ ID NO: 2264 - protein, 126 aa, Artificial Sequence; identical to SEQ ID NO: 1305
  Description of Artificial Sequence: Synthetic polypeptide

SEQ ID NO: 2265 - protein, 127 aa, Artificial Sequence; identical to SEQ ID NO: 1306
  Description of Artificial Sequence: Synthetic polypeptide

SEQ ID NO: 2266 - protein, 120 aa, Artificial Sequence; identical to SEQ ID NO: 1307
  Description of Artificial Sequence: Synthetic polypeptide

SEQ ID NO: 2267 - protein, 120 aa, Artificial Sequence; identical to SEQ ID NO: 1308
  Description of Artificial Sequence: Synthetic polypeptide

SEQ ID NO: 2268 - protein, 123 aa, Artificial Sequence; identical to SEQ ID NO: 1309
  Description of Artificial Sequence: Synthetic polypeptide

SEQ ID NO: 2269 - protein, 116 aa, Artificial Sequence; identical to SEQ ID NO: 1310
  Description of Artificial Sequence: Synthetic polypeptide

SEQ ID NO: 2270 - protein, 115 aa, Artificial Sequence; identical to SEQ ID NO: 1311
  Description of Artificial Sequence: Synthetic polypeptide

SEQ ID NO: 2271 - protein, 125 aa, Artificial Sequence; identical to SEQ ID NO: 1312
  Description of Artificial Sequence: Synthetic polypeptide

SEQ ID NO: 2272 - protein, 119 aa, Artificial Sequence; identical to SEQ ID NO: 1313
  Description of Artificial Sequence: Synthetic polypeptide

SEQ ID NO: 2273 - protein, 119 aa, Artificial Sequence; identical to SEQ ID NO: 1314
  Description of Artificial Sequence: Synthetic polypeptide

SEQ ID NO: 2274 - protein, 120 aa, Artificial Sequence; identical to SEQ ID NO: 1315
  Description of Artificial Sequence: Synthetic polypeptide

SEQ ID NO: 2275 - protein, 119 aa, Artificial Sequence; identical to SEQ ID NO: 1316
  Description of Artificial Sequence: Synthetic polypeptide

SEQ ID NO: 2276 - protein, 123 aa, Artificial Sequence; identical to SEQ ID NO: 1317
  Description of Artificial Sequence: Synthetic polypeptide

SEQ ID NO: 2277 - protein, 122 aa, Artificial Sequence; identical to SEQ ID NO: 1318
  Description of Artificial Sequence: Synthetic polypeptide

SEQ ID NO: 2278 - protein, 118 aa, Artificial Sequence; identical to SEQ ID NO: 1319
  Description of Artificial Sequence: Synthetic polypeptide

SEQ ID NO: 2279 - protein, 120 aa, Artificial Sequence; identical to SEQ ID NO: 1320
  Description of Artificial Sequence: Synthetic polypeptide

SEQ ID NO: 2280 - protein, 122 aa, Artificial Sequence; identical to SEQ ID NO: 1321
  Description of Artificial Sequence: Synthetic polypeptide

SEQ ID NO: 2281 - protein, 119 aa, Artificial Sequence; identical to SEQ ID NO: 1322
  Description of Artificial Sequence: Synthetic polypeptide

SEQ ID NO: 2282 - protein, 123 aa, Artificial Sequence; identical to SEQ ID NO: 1323
  Description of Artificial Sequence: Synthetic polypeptide

SEQ ID NO: 2283 - protein, 118 aa, Artificial Sequence; identical to SEQ ID NO: 1324
  Description of Artificial Sequence: Synthetic polypeptide

SEQ ID NO: 2284 - protein, 118 aa, Artificial Sequence; identical to SEQ ID NO: 1326
  Description of Artificial Sequence: Synthetic polypeptide

SEQ ID NO: 2285 - protein, 118 aa, Artificial Sequence; identical to SEQ ID NO: 1327
  Description of Artificial Sequence: Synthetic polypeptide

SEQ ID NO: 2286 - protein, 123 aa, Artificial Sequence; identical to SEQ ID NO: 1328
  Description of Artificial Sequence: Synthetic polypeptide

SEQ ID NO: 2287 - protein, 123 aa, Artificial Sequence; identical to SEQ ID NO: 1329
  Description of Artificial Sequence: Synthetic polypeptide

SEQ ID NO: 2288 - protein, 119 aa, Artificial Sequence; identical to SEQ ID NO: 1330
  Description of Artificial Sequence: Synthetic polypeptide

SEQ ID NO: 2289 - protein, 121 aa, Artificial Sequence; identical to SEQ ID NO: 1331
  Description of Artificial Sequence: Synthetic polypeptide

SEQ ID NO: 2290 - protein, 116 aa, Artificial Sequence; identical to SEQ ID NO: 1332
  Description of Artificial Sequence: Synthetic polypeptide

SEQ ID NO: 2291 - protein, 123 aa, Artificial Sequence; identical to SEQ ID NO: 1333
  Description of Artificial Sequence: Synthetic polypeptide

SEQ ID NO: 2292 - protein, 120 aa, Artificial Sequence; identical to SEQ ID NO: 1334
  Description of Artificial Sequence: Synthetic polypeptide

SEQ ID NO: 2293 - protein, 128 aa, Artificial Sequence; identical to SEQ ID NO: 1335
  Description of Artificial Sequence: Synthetic polypeptide

SEQ ID NO: 2294 - protein, 116 aa, Artificial Sequence; identical to SEQ ID NO: 1336
  Description of Artificial Sequence: Synthetic polypeptide

SEQ ID NO: 2295 - protein, 122 aa, Artificial Sequence; identical to SEQ ID NO: 1337
  Description of Artificial Sequence: Synthetic polypeptide

SEQ ID NO: 2296 - protein, 114 aa, Artificial Sequence; identical to SEQ ID NO: 1338
  Description of Artificial Sequence: Synthetic polypeptide

SEQ ID NO: 2297 - protein, 125 aa, Artificial Sequence; identical to SEQ ID NO: 1339
  Description of Artificial Sequence: Synthetic polypeptide

SEQ ID NO: 2298 - protein, 120 aa, Artificial Sequence; identical to SEQ ID NO: 1340
  Description of Artificial Sequence: Synthetic polypeptide

SEQ ID NO: 2299 - protein, 119 aa, Artificial Sequence; identical to SEQ ID NO: 1341
  Description of Artificial Sequence: Synthetic polypeptide

SEQ ID NO: 2300 - protein, 125 aa, Artificial Sequence; identical to SEQ ID NO: 1342
  Description of Artificial Sequence: Synthetic polypeptide

SEQ ID NO: 2301 - protein, 119 aa, Artificial Sequence; identical to SEQ ID NO: 1343
  Description of Artificial Sequence: Synthetic polypeptide

SEQ ID NO: 2302 - protein, 121 aa, Artificial Sequence
  Description of Artificial Sequence: Synthetic polypeptide
EVQLVESGGGLVQPGGSLRLSCAASGFTLGDYVMGWFRQAPGKEREFVAAIHSGGSTYADSVKGRFTISADNSKNTAYLQMNSLKPEDTAVYYCAAKEYGGTRRYDRAYNWGQGTLVTVSS

SEQ ID NO: 2303 - protein, 115 aa, Artificial Sequence
  Description of Artificial Sequence: Synthetic polypeptide
EVQLVESGGGLVQPGGSLRLSCAASGGGTFGSYAMGWFRQAPGKERELVAAISSGGSTNYADSVKGRFTISADNSKNTAYLQMNSLKPEDTAVYYCARGDWRYGWGQGTLVTVSS

SEQ ID NO: 2304 - protein, 124 aa, Artificial Sequence
  Description of Artificial Sequence: Synthetic polypeptide
EVQLVESGGGLVQPGGSLRLSCAASGRTYSISAMGWFRQAPGKEREFVAAISMSGDDSAYADSVKGRFTISADNSKNTAYLQMNSLKPEDTAVYYCAAQLGYESGYSLTYDYDWGQGTLVTVSS

SEQ ID NO: 2305 - protein, 123 aa, Artificial Sequence
  Description of Artificial Sequence: Synthetic polypeptide
EVQLVESGGGLVQPGGSLRLSCAASGGTFSTYPMGWFRQAPGKEREFVAAITSDGSTLYADSVKGRFTISADNSKNTAYLQMNSLKPEDTAVYYCAATDYNKAYAREGRRYDWGQGTLVTVSS

SEQ ID NO: 2306 - protein, 123 aa, Artificial Sequence
  Description of Artificial Sequence: Synthetic polypeptide
EVQLVESGGGLVQPGGSLRLSCAASGSIFRINAMGWFRQAPGKEREFVAAIHWSGSSTRYADSVKGRFTISADNSKNTAYLQMNSLKPEDTAVYYCAAQDRRRGDYYTFDYHWGQGTLVTVSS

SEQ ID NO: 2307 - protein, 114 aa, Artificial Sequence
  Description of Artificial Sequence: Synthetic polypeptide
EVQLVESGGGLVQPGGSLRLSCAASGGTFNNYAMGWFRQAPGKERELVAAITSGGSTDYADSVKGRFTISADNSKNTAYLQMNSLKPEDTAVYYCARGDWRYGWGQGTLVTVSS

SEQ ID NO: 2308 - protein, 116 aa, Artificial Sequence
  Description of Artificial Sequence: Synthetic polypeptide
EVQLVESGGGLVQPGGSLRLSCAASGTIVNINVMGWFRQAPGKEREFVAAIHWSGGLKAYADSVKGRFTISADNSKNTAYLQMNSLKPEDTAVYYCAMNRAGIYEWGQGTLVTVSS

SEQ ID NO: 2309 - protein, 114 aa, Artificial Sequence
  Description of Artificial Sequence: Synthetic polypeptide
EVQLVESGGGLVQPGGSLRLSCAASGSTFSNYAMGWFRQAPGKERELVAAITSGGSTSYADSVKGRFTISADNSKNTAYLQMNSLKPEDTAVYYCARGDWRYGWGQGTLVTVSS

SEQ ID NO: 2310 - protein, 123 aa, Artificial Sequence
  Description of Artificial Sequence: Synthetic polypeptide
EVQLVESGGGLVQPGGSLRLSCAASGFSFDDYVMGWFRQAPGKEREFVAAISRSGNLKSYADSVKGRFTISADNSKNTAYLQMNSLKPEDTAVYYCAAKEYGGTRRYDRAYNWGQGTLVTVSS

SEQ ID NO: 2311 - protein, 115 aa, Artificial Sequence
  Description of Artificial Sequence: Synthetic polypeptide
EVQLVESGGGLVQPGGSLRLSCAASGSAFRSTVMGWFRQAPGKEREFVAAVIGSSGITDYADSVKGRFTISADNSKNTAYLQMNSLKPEDTAVYYCARGDWRYGWGQGTLVTVSS

SEQ ID NO: 2312 - protein, 116 aa, Artificial Sequence
  Description of Artificial Sequence: Synthetic polypeptide
EVQLVESGGGLVQPGGSLRLSCAASGRTFSDAGMGWFRQAPGKEREFVAAISRSGNLKAYADSVKGRFTISADNSKNTAYLQMNSLKPEDTAVYYCAVQVNGTWAWGQGTLVTVSS

SEQ ID NO: 2313 - protein, 115 aa, Artificial Sequence
  Description of Artificial Sequence: Synthetic polypeptide
EVQLVESGGGLVQPGGSLRLSCAASGFTLDYYAMGWFRQAPGKERELVAAISWNGGSTSYADSVKGRFTISADNSKNTAYLQMNSLKPEDTAVYYCARGDWRYGWGQGTLVTVSS

SEQ ID NO: 2314 - protein, 120 aa, Artificial Sequence
  Description of Artificial Sequence: Synthetic polypeptide
EVQLVESGGGLVQPGGSLRLSCAASGGTFSTYVMGWFRQAPGKEREFVAAISWSGESTLYADSVKGRFTISADNSKNTAYLQMNSLKPEDTAVYYCAADLMYGVDRRYDWGQGTLVTVSS

SEQ ID NO: 2315 - protein, 114 aa, Artificial Sequence
  Description of Artificial Sequence: Synthetic polypeptide
EVQLVESGGGLVQPGGSLRLSCAASGISSSKRNMGWFRQAPGKEREFVAGISWTGGITYYADSVKGRFTISADNSKNTAYLQMNSLKPEDTAVYYCAIAGRGRWGQGTLVTVSS

SEQ ID NO: 2316 - protein, 122 aa, Artificial Sequence
  Description of Artificial Sequence: Synthetic polypeptide
EVQLVESGGGLVQPGGSLRLSCAASGRRFSAYGMGWFRQAPGKEREFVAVISRSGTLTRYADSVKGRFTISADNSKNTAYLQMNSLKPEDTAVYYCASSGPADARNGERWHWGQGTLVTVSS

SEQ ID NO: 2317 - protein, 123 aa, Artificial Sequence
  Description of Artificial Sequence: Synthetic polypeptide
EVQLVESGGGLVQPGGSLRLSCAASGLTFSSFVMGWFRQAPGKEREFVAAISSNGGSTRYADSVKGRFTISADNSKNTAYLQMNSLKPEDTAVYYCAAKEYGGTRRYDRAYNWGQGTLVTVSS

SEQ ID NO: 2318 - protein, 124 aa, Artificial Sequence
  Description of Artificial Sequence: Synthetic polypeptide
EVQLVESGGGLVQPGGSLRLSCAASGTVFSISAMGWFRQAPGKEREFVAAISMSGDDTAYADSVKGRFTISADNSKNTAYLQMNSLKPEDTAVYYCAAQLGYESGYSLTYDYDWGQGTLVTVSS

SEQ ID NO: 2319 - protein, 117 aa, Artificial Sequence
  Description of Artificial Sequence: Synthetic polypeptide
EVQLVESGGGLVQPGGSLRLSCAASGSIFSPNVMGWFRQAPGKEREFVAAITNGGSTKYADSVKGRFTISADNSKNTAYLQMNSLKPEDTAVYYCAAQRWRGGSYEWGQGTLVTVSS

SEQ ID NO: 2320 - protein, 123 aa, Artificial Sequence
  Description of Artificial Sequence: Synthetic polypeptide
EVQLVESGGGLVQPGGSLRLSCAASGIPASIRVMGWFRQAPGKEREFVAAIHWSGSSTRYADSVKGRFTISADNSKNTAYLQMNSLKPEDTAVYYCALSRAIVPGDSEYDYRWGQGTLVTVSS

SEQ ID NO: 2321 - protein, 124 aa, Artificial Sequence
  Description of Artificial Sequence: Synthetic polypeptide
EVQLVESGGGLVQPGGSLRLSCAASGRTFSMSAMGWFRQAPGKEREFVSAISWSGGSTLYADSVKGRFTISADNSKNTAYLQMNSLKPEDTAVYYCAAQLGYESGYSLTYDYDWGQGTLVTVSS

SEQ ID NO: 2322 - protein, 114 aa, Artificial Sequence
  Description of Artificial Sequence: Synthetic polypeptide
EVQLVESGGGLVQPGGSLRLSCAASGRTFSNYAMGWFRQAPGKERELVAAITSGGSTDYADSVKGRFTISADNSKNTAYLQMNSLKPEDTAVYYCARGDWRYGWGQGTLVTVSS

SEQ ID NO: 2323 - protein, 114 aa, Artificial Sequence
  Description of Artificial Sequence: Synthetic polypeptide
EVQLVESGGGLVQPGGSLRLSCAASGRTFSSYAMGWFRQAPGKERELVAAISTGGSTYYADSVKGRFTISADNSKNTAYLQMNSLKPEDTAVYYCARGDWRYGWGQGTLVTVSS

SEQ ID NO: 2324 - protein, 122 aa, Artificial Sequence
  Description of Artificial Sequence: Synthetic polypeptide
EVQLVESGGGLVQPGGSLRLSCAASGRSFSSVGMGWFRQAPGKEREFVAVISRSGASTAYADSVKGRFTISADNSKNTAYLQMNSLKPEDTAVYYCASAGPADARNGERWAWGQGTLVTVSS

SEQ ID NO: 2325 - protein, 117 aa, Artificial Sequence
  Description of Artificial Sequence: Synthetic polypeptide
EVQLVESGGGLVQPGGSLRLSCAASGRAFRRYTMGWFRQAPGKERELIAVINWSGDRRYYADSVKGRFTISADNSKNTAYLQMNSLKPEDTAVYYCAATLAKGGGRWGQGTLVTVSS

SEQ ID NO: 2326 - protein, 121 aa, Artificial Sequence
  Description of Artificial Sequence: Synthetic polypeptide
EVQLVESGGGLVQPGGSLRLSCAAMAWAGFARRRAKNAKWWRALPRGGPTYADSVKGRFTISADNSKNTAYLQMNSLKPEDTAVYYCAAGGMWYGSSLYVRFDLLEDGMDWGQGTLVTVSS

SEQ ID NO: 2327 - protein, 122 aa, Artificial Sequence
  Description of Artificial Sequence: Synthetic polypeptide
EVQLVESGGGLVQPGGSLRLSCAASGSISSINGMGWFRQAPGKERELVALISRSGGTTYYADSVKGRFTISADNSKNTAYLQMNSLKPEDTAVYYCASAGPADARNGERWAWGQGTLVTVSS

SEQ ID NO: 2328 - protein, 114 aa, Artificial Sequence
  Description of Artificial Sequence: Synthetic polypeptide
EVQLVESGGGLVQPGGSLRLSCAASGRTFSNNVMGWFRQAPGKERELVAAAISGGSTYYADSVKGRFTISADNSKNTAYLQMNSLKPEDTAVYYCARGDWRYGWGQGTLVTVSS

SEQ ID NO: 2329 - protein, 123 aa, Artificial Sequence
  Description of Artificial Sequence: Synthetic polypeptide
EVQLVESGGGLVQPGGSLRLSCAASGRTFSISAMGWFRQAPGKEREFVAAISRSGTTMYADSVKGRFTISADNSKNTAYLQMNSLKPEDTAVYYCAAQLGYESGYSLTYDYDWGQGTLVTVSS

SEQ ID NO: 2330 - protein, 125 aa, Artificial Sequence
  Description of Artificial Sequence: Synthetic polypeptide
EVQLVESGGGLVQPGGSLRLSCAASGGTFSYYDLAAMGWFRQAPGKEREFVAAISWSQYNTKYADSVKGRFTISADNSKNTAYLQMNSLKPEDTAVYYCAARVVVRTAHGFEDNWGQGTLVTVSS

SEQ ID NO: 2331 - protein, 119 aa, Artificial Sequence
  Description of Artificial Sequence: Synthetic polypeptide
EVQLVESGGGLVQPGGSLRLSCAASGRTFNNYGMGWFRQAPGKEREFVAVISRSGSLKAYADSVKGRFTISADNSKNTAYLQMNSLKPEDTAVYYCASDPTYGSGRWTWGQGTLVTVSS

SEQ ID NO: 2332 - protein, 123 aa, Artificial Sequence
  Description of Artificial Sequence: Synthetic polypeptide
EVQLVESGGGLVQPGGSLRLNCAASGFTLDDYVMGWFRQTPGKEREFVAAISSSGALTSYADSVKGRFTISADNSKNTAYLQMNSLKPEDAAVYYCAAKEYGGTRRYDRAYNWGQGTLVTVSS

SEQ ID NO: 2333 - protein, 121 aa, Artificial Sequence
  Description of Artificial Sequence: Synthetic polypeptide
EVQLVESGGGLVQPGGSLRLSCAASGRTFNAMGWFRQAPGKEREFVAAIRWSGDMSVYADSVKGRFTISADNSKNTAYLQMNSLKPEDTAVYYCAAQDRRRGDYYTFDYHWGQGTLVTVSS

SEQ ID NO: 2334 - protein, 114 aa, Artificial Sequence
  Description of Artificial Sequence: Synthetic polypeptide
EVQLVESGGGLVQPGGSLRLSCAASGLTFSTYAMGWFRQAPGKEREFVAAITSGGSTDYADSVKGRFTISADNSKNTAYLQMNSLKPEDTAVYYCARGDWRYGWGQGTLVTVSS

SEQ ID NO: 2335 - protein, 114 aa, Artificial Sequence
  Description of Artificial Sequence: Synthetic polypeptide
EVQLVESGGGLVQPGGSLRLSCAASGSIFTINAMGWFRQAPGKEREGVAAIGSDGSTSYADSVKGRFTISADNSKNTAYLQMNSLKPEDTAVYYCAVVRWGADWGQGTLVTVSS

SEQ ID NO: 2336 - protein, 116 aa, Artificial Sequence
  Description of Artificial Sequence: Synthetic polypeptide
EVQLVESGGGLVQPGGSLRLSCAASGLTFSSYAMGWFRQAPGKERELVAAITSSSGSTPAYADSVKGRFTISADNSKNTAYLQMNSLKPEDTAVYYCARGDWRYGWGQGTLVTVSS

SEQ ID NO: 2337 - protein, 123 aa, Artificial Sequence
  Description of Artificial Sequence: Synthetic polypeptide
EVQLVESGGGLVQPGGSLRLSCAASGIPFSTRTMGWFRQAPGKEREFVAAISWSQYNTKYADSVKGRFTISADNSKNTAYLQMNSLKPEDTAVYYCAARHWGMFSRSENDYNWGQGTLVTVSS

SEQ ID NO: 2338 - protein, 125 aa, Artificial Sequence
  Description of Artificial Sequence: Synthetic polypeptide
EVQLVESGGGLVQPGGSLRLSCAASGRSRFSTYVMGWFRQAPGKEREFVAAISWSQYNTKYADSVKGRFTISADNSKNTAYLQMNSLKPEDTAVYYCAAGNGGRNYGHSRARYDWGQGTLVTVSS

SEQ ID NO: 2339 - protein, 118 aa, Artificial Sequence
  Description of Artificial Sequence: Synthetic polypeptide
EVQLVESGGGLVQPGGSLRLSCAASGLTLSSYGMGWFRQAPGKEREYVAVISRSGSLKAYADSVKGRFTISADNSKNTAYLQMNSLKPEDTAVYYCATRADAEGWWDWGQGTLVTVSS

SEQ ID NO: 2340 - protein, 113 aa, Artificial Sequence
  Description of Artificial Sequence: Synthetic polypeptide
EVQLVESGGGLVQPGGSLRLSCAASGSIFRVNVMGWFRQAPGKEREFVAAINNFGTTKYADSVKGRFTISADNSKNTAYLQMNSLKPEDTAVYYCAADLPSRWGQGTLVTVSS

SEQ ID NO: 2341 - protein, 114 aa, Artificial Sequence
  Description of Artificial Sequence: Synthetic polypeptide
EVQLVESGGGLVQPGGSLRLSCAASGRTFRNYAMGWFRQAPGKERELVAAISSGGSTDYADSVKGRFTISADNSKNTAYLQMNSLKPEDTAVYYCARGDWRYGWGQGTLVTVSS

SEQ ID NO: 2342 - protein, 114 aa, Artificial Sequence
  Description of Artificial Sequence: Synthetic polypeptide
EVQLVESGGGLVQPGGSLRLSCAASGRTFSSFAMGWFRQAPGKERELVAAISSGGSTNYADSVKGRFTISADNSKNTAYLQMNSLKPEDTAVYYCARGDWRYGWGQGTLVTVSS

SEQ ID NO: 2343 - protein, 123 aa, Artificial Sequence
  Description of Artificial Sequence: Synthetic polypeptide
EVQLVESGGGLVQPGGSLRLSCAASGTTFRINAMGWFRQAPGKEREFVAAMNWSGGSTKYADSVKGRFTISADNSKNTAYLQMNSLKPEDTAVYYCAAQDRRRGDYYTFDYHWGQGTLVTVSS

SEQ ID NO: 2344 - protein, 122 aa, Artificial Sequence
  Description of Artificial Sequence: Synthetic polypeptide
EVQLVESGGGLVQPGGSLRLSCAASGFTLGDYVMGWFRQAPGKEREFVAAIHSGGSTLYADSVKGRFTISADNSKNTAYLQMNSLKPEDTAVYYCAAKEYGGTRRYDRTYNWGQGTLVTVSS

SEQ ID NO: 2345 - protein, 112 aa, Artificial Sequence
  Description of Artificial Sequence: Synthetic polypeptide
EVQLVESGGGLVQPGGSLRLSCAASGFTFSRSAMGWFRQAPGKERELVAGILSSGATVYADSVKGRFTISADNSKNTAYLQMNSLKPEDTAVYYCAKAPRDWGQGTLVTVSS

SEQ ID NO: 2346 - protein, 114 aa, Artificial Sequence
  Description of Artificial Sequence: Synthetic polypeptide
EVQLVESGGGLVQPGGSLRLSCAASGRTFNNYAMGWFRQAPGKERELVAAITSGGSTDYADSVKGRFTISADNSKNTAYLQMNSLKPEDTAVYYCARGDWRYGWGQGTLVTVSS

SEQ ID NO: 2347 - protein, 116 aa, Artificial Sequence
  Description of Artificial Sequence: Synthetic polypeptide
EVQLVESGGGLVQPGGSLRLSCAASGFTFRSYPMGWFRQAPGKEREFVAAINNFGTTKYADSVKGRFTISADNSKNTAYLQMNSLKPEDTAVYYCAAAKGIGVYGWGQGTLVTVSS

SEQ ID NO: 2348 - protein, 121 aa, Artificial Sequence
  Description of Artificial Sequence: Synthetic polypeptide
EVQLVESGGGLVQPGGSLRLSCAASGNIFTRNVMGWFRQAPGKEREFVAAIHWNGDSTKYADSVKGRFTISADNSKNTAYLQMNSLKPEDTAVYYCAAGSNIGGSRWRYDWGQGTLVTVSS

SEQ ID NO: 2349 - protein, 123 aa, Artificial Sequence
  Description of Artificial Sequence: Synthetic polypeptide
EVQLVESGGGLVQPGGSLRLSCAASGRTISRYTMGWFRQAPGKERELVAAIKWSGASTVYADSVKGRFTISADNSKNTAYLQMNSLKPEDTAVYYCAAKGIWDYLGRRDFGDWGQGTLVTVSS

SEQ ID NO: 2350 - protein, 124 aa, Artificial Sequence
  Description of Artificial Sequence: Synthetic polypeptide
EVQLVESGGGLVQPGGSLRLSCAASGFRFSSYGMGWFRQAPGKEREFVAIITSGGLTVYADSVKGRFTISADNSKNTAYLQMNSLKPEDTAVYYCAARKTFYFGTSSYPNDYAWGQGTLVTVSS

SEQ ID NO: 2351 - protein, 114 aa, Artificial Sequence
  Description of Artificial Sequence: Synthetic polypeptide
EVQLVESGGGLVQPGGSLRLSCAASGRTFDNHAMGWFRQAPGKEREGVAAIGSDGSTSYADSVKGRFTISADNSKNTAYLQMNSLKPEDTAVYYCAVVRWGVDWGQGTLVTVSS

SEQ ID NO: 2352 - protein, 115 aa, Artificial Sequence
  Description of Artificial Sequence: Synthetic polypeptide
EVQLVESGGGLVQPGGSLRLSCAASGFTFSSHAMGWFRQAPGKEREFVAGISWSGESTLTRYADSVKGRFTISADNSKNTAYLQMNSLKPEDTAVYYCADVNGDWGQGTLVTVSS

SEQ ID NO: 2353 - protein, 124 aa, Artificial Sequence
  Description of Artificial Sequence: Synthetic polypeptide
EVQLVESGGGLVQPGGSLRLSCAASGMTFRLYAMGWFRQAPGKEREFVAAISWSQYNTKYADSVKGRFTISADNSKNTAYLQMNSLKPEDTAVYYCAAQLGYESGYSLTYDYDWGQGTLVTVSS

SEQ ID NO: 2354 - protein, 115 aa, Artificial Sequence
  Description of Artificial Sequence: Synthetic polypeptide
EVQLVESGGGLVQPGGSLRLSCAASGGTFRKLAMGWFRQAPGKEREFVAVISWTGGSSYYADSVKGRFTISADNSKNTAYLQMNSLKPEDTAVYYCARLTSFATWGQGTLVTVSS

SEQ ID NO: 2355 - protein, 118 aa, Artificial Sequence
  Description of Artificial Sequence: Synthetic polypeptide
EVQLVESGGGLVQPGGSLRLSCAASGRTFSANGMGWFRQAPGKEREFVAAISASGTLRAYADSVKGRFTISADNSKNTAYLQMNSLKPEDTAVYYCAARSPMSPTWDWGQGTLVTVSS

SEQ ID NO: 2356 - protein, 121 aa, Artificial Sequence
  Description of Artificial Sequence: Synthetic polypeptide
EVQLVESGGGLVQPGGSLRLSCAASGSAFRSTVMGWFRQAPGKEREFVAAISWTGESTLYADSVKGRFTISADNSKNTAYLQMNSLKPEDTAVYYCATGPYRSYFARSYLWGQGTLVTVSS

SEQ ID NO: 2357 - protein, 117 aa, Artificial Sequence
  Description of Artificial Sequence: Synthetic polypeptide
EVQLVESGGGLVQPGGSLRLSCAASGGTFDYSGMGWFRQAPGKEREFVAVVSQSGRTTYYADSVKGLFTITADNSKNTAYLQMNLLKPEDTAVYYCPTATRPGEWDGGQGTLVTVSR

SEQ ID NO: 2358 - protein, 111 aa, Artificial Sequence
  Description of Artificial Sequence: Synthetic polypeptide
EVQLVESGGGLVQPGGSLRLSCAASGVFGPIRAMGWFRQAPGKERELVALMGNDGSTYADSVKGRFTISADNSKNTAYLQMNSLKPEDTAVYYCAAIGWRWGQGTLVTVSS

SEQ ID NO: 2359 - protein, 121 aa, Artificial Sequence
  Description of Artificial Sequence: Synthetic polypeptide
EVQLVESGGGLVQPGGSLRLSCAASGFNFNWYPMGWFRQAPGKEREFVAAIRWSGGITYYADSVKGRFTISADNSKNTAYLQMNSLKPEDTAVYYCATGPYRSYFARSYLWGQGTLVTVSS

SEQ ID NO: 2360 - protein, 112 aa, Artificial Sequence
  Description of Artificial Sequence: Synthetic polypeptide
EVQLVESGGGLVQPGGSLRLSCAASGMTFHRYVMGWFRQAPGKERELVASITTGGTPNYADSVKGRFTIITDNNKNTAYLLMINLQPEDTAVYYCCKVPYIWGQGTLGTVGT

SEQ ID NO: 2361 - protein, 113 aa, Artificial Sequence
  Description of Artificial Sequence: Synthetic polypeptide
EVQLVESGGGLVQPGGSLRLSCAASGISTMGWFRQAPGKEREFVAAINNFGTTKYADSVKGRFTISADNSKNTAYLQMNSLKPEDTAVYYCAAASQSGSGYDWGQGTLVTVSS

SEQ ID NO: 2362 - protein, 111 aa, Artificial Sequence
  Description of Artificial Sequence: Synthetic polypeptide
EVQLVESGGGLVQPGGSLRLSCAASGRAFNTRAMGWFRQAPGKERELVALMGNDGSTYADSVKGRFTISADNSKNTAYLQMNSLKPEDTAVYYCAAIGWRWGQGTLVTVSS

SEQ ID NO: 2363 - protein, 123 aa, Artificial Sequence
  Description of Artificial Sequence: Synthetic polypeptide
EVQLVESGGGLVQPGGSLRLSCAASGLTDRRYTMGWFRQAPGKEREFVAAINSGGSTLYADSVKGRFTISADNSKNTAYLQMNSLKPEDTAVYYCAAGNGGRTYGHSRARYEWGQGTLVTVSS

SEQ ID NO: 2364 - protein, 111 aa, Artificial Sequence
  Description of Artificial Sequence: Synthetic polypeptide
EVQLVESGGGLVQPGGSLRLSCAASGRTFNVMGWFRQAPGKERELVALMGNDGSTYADSVKGRFTISADNSKNTAYLQMNSLKPEDTAVYYCAAVRWGVDWGQGTLVTVSS

SEQ ID NO: 2365 - protein, 112 aa, Artificial Sequence
  Description of Artificial Sequence: Synthetic polypeptide
EVQLVESGGGLVQPGGSLRLSCAASGRAFNTRAMGWFRQAPGKERELVALMGNDGSTNYADSVKGRFTISADNSKNTAYLQMNSLKPEDTAVYYCAAIGWRWGQGTLVTVSS

SEQ ID NO: 2366 - protein, 117 aa, Artificial Sequence
  Description of Artificial Sequence: Synthetic polypeptide
EVQVVESGGGVVHPGGSVRMRCAASGVTVDYSGMGWFGQAPGKEREFVAVVSQSARTTYYADSVKGRFTISADNSKNTEYLQMNSMKPEDTAVYYCATATRPGEWDWGQGTLVTVSS

SEQ ID NO: 2367 - protein, 124 aa, Artificial Sequence
  Description of Artificial Sequence: Synthetic polypeptide
EVQLVESGGGLVQPGGSLRLSCAASGRTPRLGAMGWFRQAPGKEREFVAAISRSGGLTSYADSVKGRFTISADNSKNTAYLQMNSLKPEDTAVYYCAAQLVGSNIGGSRWRYDWGQGTLVTVSS

SEQ ID NO: 2368 - protein, 114 aa, Artificial Sequence
  Description of Artificial Sequence: Synthetic polypeptide
EVQLVESGGGLVQPGGSLRLSCAASGLTFRNYAMGWFRQAPGKEREFVAAITSGGSTLYADSVKGRFTISADNSKNTAYLQMNSLKPEDTAVYYCARGDWRYGWGHGTLVTESS

SEQ ID NO: 2369 - protein, 114 aa, Artificial Sequence
  Description of Artificial Sequence: Synthetic polypeptide
EVQLVESGGGLVQPGGSLRLSCAASGGRTFSDLAMGWFRQAPGKEREFVALITRSGGTTFYADSVKGRFTISADNSKNTAYLQMNSLKPEDTAVYYCAIGRGSWGQGTLVTVSS

SEQ ID NO: 2370 - protein, 117 aa, Artificial Sequence
  Description of Artificial Sequence: Synthetic polypeptide
EVQLVESGGGLVQPGGSLRLSCAASGFTFGEYAMGWFRQAPGKEREFVAAVSSLGPFTRYADSVKGRFTISADNSKNTAYLQMNSLKPEDTAVYYCAAVLDGYSGSWGQGTLVTVSS

SEQ ID NO: 2371 - protein, 124 aa, Artificial Sequence
  Description of Artificial Sequence: Synthetic polypeptide
EVQLVESGGGLVQPGGSLRLSCAASGFAFSSYGMGWFRQAPGKEREFVAAISWSGVRSGVSAIYADSVKGRFTISADNSKNTAYLQMNSLKPEDTAVYYCTTDLTGDLWYFDLWGQGTLVTVSS

SEQ ID NO: 2372 - protein, 119 aa, Artificial Sequence
  Description of Artificial Sequence: Synthetic polypeptide
EVQLVESGGGLVQPGGSLRLSCAASGLTAGTYAMCWFRQAPGKEREGVACASSTDGSTAYADSVKGRFTISADNSKNTAYLQMNSLKPEDTAVYYCAAVRTYGSATYDWGQGTLVTVSS

SEQ ID NO: 2373 - protein, 123 aa, Artificial Sequence
  Description of Artificial Sequence: Synthetic polypeptide
EVQLVESGGGLVQPGGSLRLSCAASGFTLDDYVMGWFRQAPGKERELVAAVSSLGPFTRYADSVKGRFTISADNSKNTAYLQMNSLKPEDTAVYYCAAKEYGGTRRYDRAYNWGQGTLVTVSS

SEQ ID NO: 2374 - protein, 118 aa, Artificial Sequence
  Description of Artificial Sequence: Synthetic polypeptide
EVQLVESGGGLVQPGGSLRLSCAASGPTLGSYVMGWFRQAPGKEREFVAAISWSQYNTKYADSVKGRFTISADNSKNTAYLQMNSLKPEDTAVYYCAAQRWRGGSYEWGQGTLVTVSS

SEQ ID NO: 2375 - protein, 118 aa, Artificial Sequence
  Description of Artificial Sequence: Synthetic polypeptide
EVQLVESGGGLVQPGGSLRLSCAASGPTFSSYVMGWFRQAPGKEREFVAAISWSQYNTKYADSVKGRFTISADNSKNTAYLQMNSLKPEDTAVYYCAAASRSGSGYDWGQGTLVTVSS

SEQ ID NO: 2376 - protein, 120 aa, Artificial Sequence
  Description of Artificial Sequence: Synthetic polypeptide
EVQLVESGGGLVQPGGSLRLSCAASGYLYSKDCMGWFRQAPGKEREGVATICTGDGSTAYADSVKGRFTISADNSKNTAYLQMNSLKPEDTAVYYCAVIAYEEGVYRWDWGQGTLVTVSS

SEQ ID NO: 2377 - protein, 117 aa, Artificial Sequence
  Description of Artificial Sequence: Synthetic polypeptide
EVQLVESGGGLVQPGGSLRLSCAASGFTIDDYAMGWFRQAPGKEREGVAAISGSGDDTYYADSVKGRFTISADNSKNTAYLQMNSLKPEDTAVYYCAKLPYVSGDYWGQGTLVTVSS

SEQ ID NO: 2378 - protein, 116 aa, Artificial Sequence
  Description of Artificial Sequence: Synthetic polypeptide
EVQLVESGGGLVQPGGSLRLSCAASGGRFSDYGMGWFRQAPGKERELVALISRSGNLKSYADSVKGRFTISADNSKNTAYLQMNSLKPEDTAVYYCAAKTGTSFVWGQGTLVTVSS

SEQ ID NO: 2379 - protein, 114 aa, Artificial Sequence
  Description of Artificial Sequence: Synthetic polypeptide
EVQLVESGGGLVQPGGSLRLSCAASGLSFSNYAMGWFRQAPGKERELVAAITSGGSTDYADSVKGRFTISADNSKNTAYLQMNSLKPEDTAVYYCARGDWRYGWGQGTLVTVSS

SEQ ID NO: 2380 - protein, 113 aa, Artificial Sequence
  Description of Artificial Sequence: Synthetic polypeptide
EVQLVESGGGLVQPGGSLRLSCAASGIPSTLRAMGWFRQAPGKEREFVALINRSGGSQFYADSVKGRFTISADNSKNTAYLQMNSLKPEDTAVYYCAIGRGSWGQGTLVTVSS

SEQ ID NO: 2381 - protein, 9 aa, Artificial Sequence
  Description of Artificial Sequence: Synthetic peptide
RTFSRLAMG

SEQ ID NO: 2382 - protein, 8 aa, Artificial Sequence
  Description of Artificial Sequence: Synthetic peptide
SFSIAAMG

SEQ ID NO: 2383 - protein, 9 aa, Artificial Sequence
  Description of Artificial Sequence: Synthetic peptide
RTFSRYAMG

SEQ ID NO: 2384 - protein, 9 aa, Artificial Sequence
  Description of Artificial Sequence: Synthetic peptide
RTFSKYAMG

SEQ ID NO: 2385 - protein, 9 aa, Artificial Sequence
  Description of Artificial Sequence: Synthetic peptide
RTFRRYAMG

SEQ ID NO: 2386 - protein, 9 aa, Artificial Sequence
  Description of Artificial Sequence: Synthetic peptide
RTFSRFAMG

SEQ ID NO: 2387 - protein, 12 aa, Artificial Sequence
  Description of Artificial Sequence: Synthetic peptide
LGIAFSRRTAMG

SEQ ID NO: 2388 - protein, 9 aa, Artificial Sequence
  Description of Artificial Sequence: Synthetic peptide
RTFRRYPMG

SEQ ID NO: 2389 - protein, 9 aa, Artificial Sequence
  Description of Artificial Sequence: Synthetic peptide
GTLRGYGMG

SEQ ID NO: 2390 - protein, 9 aa, Artificial Sequence
  Description of Artificial Sequence: Synthetic peptide
RMFSSRSMG

SEQ ID NO: 2391 - protein, 9 aa, Artificial Sequence
  Description of Artificial Sequence: Synthetic peptide
RTFGRRAMG

SEQ ID NO: 2392 - protein, 12 aa, Artificial Sequence
  Description of Artificial Sequence: Synthetic peptide
LSSPPFDDFPMG

SEQ ID NO: 2393 - protein, 9 aa, Artificial Sequence
  Description of Artificial Sequence: Synthetic peptide
GTFSSYSMG

SEQ ID NO: 2394 - protein, 9 aa, Artificial Sequence
  Description of Artificial Sequence: Synthetic peptide
SIFSTRTMG

SEQ ID NO: 2395 - protein, 9 aa, Artificial Sequence
  Description of Artificial Sequence: Synthetic peptide
RTLWRSNMG

SEQ ID NO: 2396 - protein, 9 aa, Artificial Sequence
  Description of Artificial Sequence: Synthetic peptide
RSLGIYRMG

SEQ ID NO: 2397 - protein, 9 aa, Artificial Sequence
  Description of Artificial Sequence: Synthetic peptide
TTLTFRIMG

SEQ ID NO: 2398 - protein, 13 aa, Artificial Sequence
  Description of Artificial Sequence: Synthetic peptide
SRFSGRFNILNMG

SEQ ID NO: 2399 - protein, 9 aa, Artificial Sequence
  Description of Artificial Sequence: Synthetic peptide
TLFKINAMG

SEQ ID NO: 2400 - protein, 9 aa, Artificial Sequence
  Description of Artificial Sequence: Synthetic peptide
IPFRSRTMG

SEQ ID NO: 2401 - protein, 9 aa, Artificial Sequence
  Description of Artificial Sequence: Synthetic peptide
FTFSSFRMG

SEQ ID NO: 2402 - protein, 9 aa, Artificial Sequence
  Description of Artificial Sequence: Synthetic peptide
RNFRRNSMG

SEQ ID NO: 2403 - protein, 9 aa, Artificial Sequence
  Description of Artificial Sequence: Synthetic peptide
RNLRMYRMG

SEQ ID NO: 2404 - protein, 10 aa, Artificial Sequence
  Description of Artificial Sequence: Synthetic peptide
GLTFSSNTMG

SEQ ID NO: 2405 - protein, 9 aa, Artificial Sequence
  Description of Artificial Sequence: Synthetic peptide
FTLAYYAMG

SEQ ID NO: 2406 - protein, 9 aa, Artificial Sequence
  Description of Artificial Sequence: Synthetic peptide
RTFSSFPMG

SEQ ID NO: 2407 - protein, 9 aa, Artificial Sequence
  Description of Artificial Sequence: Synthetic peptide
ISSSKRNMG

SEQ ID NO: 2408 - protein, 9 aa, Artificial Sequence
  Description of Artificial Sequence: Synthetic peptide
RTFSIYAMG

SEQ ID NO: 2409 - protein, 9 aa, Artificial Sequence
  Description of Artificial Sequence: Synthetic peptide
RMYNSYSMG

SEQ ID NO: 2410 - protein, 9 aa, Artificial Sequence
  Description of Artificial Sequence: Synthetic peptide
RTFRSYGMG

SEQ ID NO: 2411 - protein, 7 aa, Artificial Sequence
  Description of Artificial Sequence: Synthetic peptide
RTIRTMG

SEQ ID NO: 2412 - protein, 9 aa, Artificial Sequence
  Description of Artificial Sequence: Synthetic peptide
RSFSFNAMG

SEQ ID NO: 2413 - protein, 7 aa, Artificial Sequence
  Description of Artificial Sequence: Synthetic peptide
RTYYAMG

SEQ ID NO: 2414 - protein, 9 aa, Artificial Sequence
  Description of Artificial Sequence: Synthetic peptide
RAFRRYTMG

SEQ ID NO: 2415 - protein, 9 aa, Artificial Sequence
  Description of Artificial Sequence: Synthetic peptide
RTFSNYRMG

SEQ ID NO: 2416 - protein, 9 aa, Artificial Sequence
  Description of Artificial Sequence: Synthetic peptide
ITFSPYAMG

SEQ ID NO: 2417 - protein, 14 aa, Artificial Sequence
  Description of Artificial Sequence: Synthetic peptide
RTFSGFTMSSTWMG

SEQ ID NO: 2418 - protein, 9 aa, Artificial Sequence
  Description of Artificial Sequence: Synthetic peptide
RTFRRYSMG

SEQ ID NO: 2419 - protein, 8 aa, Artificial Sequence
  Description of Artificial Sequence: Synthetic peptide
SIFSIGMG

SEQ ID NO: 2420 - protein, 9 aa, Artificial Sequence
  Description of Artificial Sequence: Synthetic peptide
RTFTSYRMG

SEQ ID NO: 2421 - protein, 12 aa, Artificial Sequence
  Description of Artificial Sequence: Synthetic peptide
RTFSSFRFRAMG

SEQ ID NO: 2422 - protein, 9 aa, Artificial Sequence
  Description of Artificial Sequence: Synthetic peptide
RTFGSYGMG

SEQ ID NO: 2423 - protein, 9 aa, Artificial Sequence
  Description of Artificial Sequence: Synthetic peptide
RTFRSYPMG

SEQ ID NO: 2424 - protein, 9 aa, Artificial Sequence
  Description of Artificial Sequence: Synthetic peptide
RTFSRSDMG

SEQ ID NO: 2425 - protein, 9 aa, Artificial Sequence
  Description of Artificial Sequence: Synthetic peptide
RTFRRYTMG

SEQ ID NO: 2426 - protein, 9 aa, Artificial Sequence
  Description of Artificial Sequence: Synthetic peptide
SIFRLSTMG

SEQ ID NO: 2427 - protein, 9 aa, Artificial Sequence
  Description of Artificial Sequence: Synthetic peptide
IAFRIRTMG

SEQ ID NO: 2428 - protein, 9 aa, Artificial Sequence
  Description of Artificial Sequence: Synthetic peptide
FTFTSYRMG

SEQ ID NO: 2429 - protein, 9 aa, Artificial Sequence
  Description of Artificial Sequence: Synthetic peptide
RTFSRYVMG

SEQ ID NO: 2430 - protein, 6 aa, Artificial Sequence
  Description of Artificial Sequence: Synthetic peptide
RTFSMG

SEQ ID NO: 2431 - protein, 9 aa, Artificial Sequence
  Description of Artificial Sequence: Synthetic peptide
RTFSTYTMG

SEQ ID NO: 2432 - protein, 9 aa, Artificial Sequence
  Description of Artificial Sequence: Synthetic peptide
RNLRMYRMG

SEQ ID NO: 2433 - protein, 9 aa, Artificial Sequence
  Description of Artificial Sequence: Synthetic peptide
ITIRTHAMG

SEQ ID NO: 2434 - protein, 9 aa, Artificial Sequence
  Description of Artificial Sequence: Synthetic peptide
RTFRRYHMG

SEQ ID NO: 2435 - protein, 9 aa, Artificial Sequence
  Description of Artificial Sequence: Synthetic peptide
RTFRRYTMG

SEQ ID NO: 2436 - protein, 9 aa, Artificial Sequence
  Description of Artificial Sequence: Synthetic peptide
RTFSWYPMG

SEQ ID NO: 2437 - protein, 9 aa, Artificial Sequence
  Description of Artificial Sequence: Synthetic peptide
RTFTSYRMG

SEQ ID NO: 2438 - protein, 9 aa, Artificial Sequence
  Description of Artificial Sequence: Synthetic peptide
RPLRRYVMG

SEQ ID NO: 2439 - protein, 9 aa, Artificial Sequence
  Description of Artificial Sequence: Synthetic peptide
RTFRRYAMG

SEQ ID NO: 2440 - protein, 9 aa, Artificial Sequence
  Description of Artificial Sequence: Synthetic peptide
RTFRRYTMG

SEQ ID NO: 2441 - protein, 9 aa, Artificial Sequence
  Description of Artificial Sequence: Synthetic peptide
RTLSTYNMG

SEQ ID NO: 2442 - protein, 9 aa, Artificial Sequence
  Description of Artificial Sequence: Synthetic peptide
RFFSTRVMG

SEQ ID NO: 2443 - protein, 9 aa, Artificial Sequence
  Description of Artificial Sequence: Synthetic peptide
RFFSICSMG

SEQ ID NO: 2444 - protein, 10 aa, Artificial Sequence
  Description of Artificial Sequence: Synthetic peptide
RMFSSRSNMG

SEQ ID NO: 2445 - protein, 9 aa, Artificial Sequence
  Description of Artificial Sequence: Synthetic peptide
RTFSSARMG

SEQ ID NO: 2446 - protein, 9 aa, Artificial Sequence
  Description of Artificial Sequence: Synthetic peptide
RTFRRYTMG

SEQ ID NO: 2447 - protein, 9 aa, Artificial Sequence
  Description of Artificial Sequence: Synthetic peptide
HTFRNYGMG

SEQ ID NO: 2448 - protein, 9 aa, Artificial Sequence
  Description of Artificial Sequence: Synthetic peptide
RTFSRYAMG

SEQ ID NO: 2449 - protein, 9 aa, Artificial Sequence
  Description of Artificial Sequence: Synthetic peptide
RNLRMYRMG

SEQ ID NO: 2450 - protein, 9 aa, Artificial Sequence
  Description of Artificial Sequence: Synthetic peptide
RTFRRYAMG

SEQ ID NO: 2451 - protein, 8 aa, Artificial Sequence
  Description of Artificial Sequence: Synthetic peptide
IPASMYLG

SEQ ID NO: 2452 - protein, 14 aa, Artificial Sequence
  Description of Artificial Sequence: Synthetic peptide
IPFRSRTFSAYAMG

SEQ ID NO: 2453 - protein, 13 aa, Artificial Sequence
  Description of Artificial Sequence: Synthetic peptide
AAISRSGRSTSYA

SEQ ID NO: 2454 - protein, 13 aa, Artificial Sequence
  Description of Artificial Sequence: Synthetic peptide
ATINYSGGGTYYA

SEQ ID NO: 2455 - protein, 13 aa, Artificial Sequence
  Description of Artificial Sequence: Synthetic peptide
AAISRSGKSTYYA

SEQ ID NO: 2456 - protein, 13 aa, Artificial Sequence
  Description of Artificial Sequence: Synthetic peptide
ALITPSSRTTYYA

SEQ ID NO: 2457 - protein, 13 aa, Artificial Sequence
  Description of Artificial Sequence: Synthetic peptide
ASINWGGGNTYYA

SEQ ID NO: 2458 - protein, 13 aa, Artificial Sequence
  Description of Artificial Sequence: Synthetic peptide
AAIRWSGGRTVYA

SEQ ID NO: 2459 - protein, 13 aa, Artificial Sequence
  Description of Artificial Sequence: Synthetic peptide
AAISWRGGNTYYA

SEQ ID NO: 2460 - protein, 13 aa, Artificial Sequence
  Description of Artificial Sequence: Synthetic peptide
AAISRSGGSTYYA

SEQ ID NO: 2461 - protein, 13 aa, Artificial Sequence
  Description of Artificial Sequence: Synthetic peptide
ASISRSGGSTYYA

SEQ ID NO: 2462 - protein, 13 aa, Artificial Sequence
  Description of Artificial Sequence: Synthetic peptide
ALINRSGGSQFYA

SEQ ID NO: 2463 - protein, 12 aa, Artificial Sequence
  Description of Artificial Sequence: Synthetic peptide
AGISRGGGTNYA

SEQ ID NO: 2464 - protein, 13 aa, Artificial Sequence
  Description of Artificial Sequence: Synthetic peptide
SSIYSDDGDSMYA

SEQ ID NO: 2465 - protein, 16 aa, Artificial Sequence
  Description of Artificial Sequence: Synthetic peptide
SAISWIIGSGGTTNYA

SEQ ID NO: 2466 - protein, 12 aa, Artificial Sequence
  Description of Artificial Sequence: Synthetic peptide
ASITKFGSTNYA

SEQ ID NO: 2467 - protein, 12 aa, Artificial Sequence
  Description of Artificial Sequence: Synthetic peptide
ASISSFGSTKYA

SEQ ID NO: 2468 - protein, 12 aa, Artificial Sequence
  Description of Artificial Sequence: Synthetic peptide
AAITSGGRKNYA

SEQ ID NO: 2469 - protein, 12 aa, Artificial Sequence
  Description of Artificial Sequence: Synthetic peptide
PAISSTGLASYT

SEQ ID NO: 2470 - protein, 13 aa, Artificial Sequence
  Description of Artificial Sequence: Synthetic peptide
ARIGYSGQSISYA

SEQ ID NO: 2471 - protein, 12 aa, Artificial Sequence
  Description of Artificial Sequence: Synthetic peptide
AQINRHGVTYYA

SEQ ID NO: 2472 - protein, 13 aa, Artificial Sequence
  Description of Artificial Sequence: Synthetic peptide
AGITGSGRSQYYA

SEQ ID NO: 2473 - protein, 12 aa, Artificial Sequence
  Description of Artificial Sequence: Synthetic peptide
AGISRGGSTNYA

SEQ ID NO: 2474 - protein, 13 aa, Artificial Sequence
  Description of Artificial Sequence: Synthetic peptide
AGISWSGARTHYA

SEQ ID NO: 2475 - protein, 13 aa, Artificial Sequence
  Description of Artificial Sequence: Synthetic peptide
ATIRWSDGSTYYA

SEQ ID NO: 2476 - protein, 12 aa, Artificial Sequence
  Description of Artificial Sequence: Synthetic peptide
ASISSSGRTSYA

SEQ ID NO: 2477 - protein, 13 aa, Artificial Sequence
  Description of Artificial Sequence: Synthetic peptide
AAISWSGRNINYA

SEQ ID NO: 2478 - protein, 12 aa, Artificial Sequence
  Description of Artificial Sequence: Synthetic peptide
AAISWSGSTSYA

SEQ ID NO: 2479 - protein, 12 aa, Artificial Sequence
  Description of Artificial Sequence: Synthetic peptide
ATWTSRGITTYA

SEQ ID NO: 2480 - protein, 12 aa, Artificial Sequence
  Description of Artificial Sequence: Synthetic peptide
ARITRGGITKYA

SEQ ID NO: 2481 - protein, 11 aa, Artificial Sequence
  Description of Artificial Sequence: Synthetic peptide
ARISPGGTFYA

SEQ ID NO: 2482 - protein, 12 aa, Artificial Sequence
  Description of Artificial Sequence: Synthetic peptide
ASISRSGTTMYA

SEQ ID NO: 2483 - protein, 12 aa, Artificial Sequence
  Description of Artificial Sequence: Synthetic peptide
ATINSRGITNYA

SEQ ID NO: 2484 - protein, 12 aa, Artificial Sequence
  Description of Artificial Sequence: Synthetic peptide
ARISRFGRTNYA

SEQ ID NO: 2485 - protein, 13 aa, Artificial Sequence
  Description of Artificial Sequence: Synthetic peptide
GAIDWSGRRITYA

SEQ ID NO: 2486 - protein, 12 aa, Artificial Sequence
  Description of Artificial Sequence: Synthetic peptide
ASITKFGSTNYA

SEQ ID NO: 2487 - protein, 12 aa, Artificial Sequence
  Description of Artificial Sequence: Synthetic peptide
ASINRGGSTKYA

SEQ ID NO: 2488 - protein, 13 aa, Artificial Sequence
  Description of Artificial Sequence: Synthetic peptide
ATINWSGGYTVYA

SEQ ID NO: 2489 - protein, 12 aa, Artificial Sequence
  Description of Artificial Sequence: Synthetic peptide
AGIITNGSTNYA

SEQ ID NO: 2490 - protein, 12 aa, Artificial Sequence
  Description of Artificial Sequence: Synthetic peptide
ASITPGGNTNYA

SEQ ID NO: 2491 - protein, 13 aa, Artificial Sequence
  Description of Artificial Sequence: Synthetic peptide
ARIWWRSGATYYA

SEQ ID NO: 2492 - protein, 13 aa, Artificial Sequence
  Description of Artificial Sequence: Synthetic peptide
AEISSSGGYTYYA

SEQ ID NO: 2493 - protein, 12 aa, Artificial Sequence
  Description of Artificial Sequence: Synthetic peptide
ALIFSGGSTYYA

SEQ ID NO: 2494 - protein, 12 aa, Artificial Sequence
  Description of Artificial Sequence: Synthetic peptide
ATISIGGRTYYA

SEQ ID NO: 2495 - protein, 12 aa, Artificial Sequence
  Description of Artificial Sequence: Synthetic peptide
ASINRGGSTNYA

SEQ ID NO: 2496 - protein, 13 aa, Artificial Sequence
  Description of Artificial Sequence: Synthetic peptide
AAISWSGGSTSYA

SEQ ID NO: 2497 - protein, 11 aa, Artificial Sequence
  Description of Artificial Sequence: Synthetic peptide
ASMRGSRSYYA

SEQ ID NO: 2498 - protein, 12 aa, Artificial Sequence
  Description of Artificial Sequence: Synthetic peptide
ASISSFGSTYYA

SEQ ID NO: 2499 - protein, 12 aa, Artificial Sequence
  Description of Artificial Sequence: Synthetic peptide
ASITSGGSTNYA

SEQ ID NO: 2500 - protein, 13 aa, Artificial Sequence
  Description of Artificial Sequence: Synthetic peptide
AGISRFFGTAYYA

SEQ ID NO: 2501 - protein, 12 aa, Artificial Sequence
  Description of Artificial Sequence: Synthetic peptide
ASISRFGRTNYA

SEQ ID NO: 2502 - protein, 12 aa, Artificial Sequence
  Description of Artificial Sequence: Synthetic peptide
ASISRFGRTNYA

SEQ ID NO: 2503 - protein, 13 aa, Artificial Sequence
  Description of Artificial Sequence: Synthetic peptide
ARIWRSGGNTYYA

SEQ ID NO: 2504 - protein, 12 aa, Artificial Sequence
  Description of Artificial Sequence: Synthetic peptide
ALISRVGVTSYA

SEQ ID NO: 2505 - protein, 13 aa, Artificial Sequence
  Description of Artificial Sequence: Synthetic peptide
ATISRSGGNTYYA

SEQ ID NO: 2506 - protein, 12 aa, Artificial Sequence
  Description of Artificial Sequence: Synthetic peptide
AAITSGGRTNYA

SEQ ID NO: 2507 - protein, 13 aa, Artificial Sequence
  Description of Artificial Sequence: Synthetic peptide
AVISWSGGSTKYA

SEQ ID NO: 2508 - protein, 13 aa, Artificial Sequence
  Description of Artificial Sequence: Synthetic peptide
ASISWGGARTYYA

SEQ ID NO: 2509 - protein, 13 aa, Artificial Sequence
  Description of Artificial Sequence: Synthetic peptide
AAITWNSGRTRYA

SEQ ID NO: 2510 - protein, 12 aa, Artificial Sequence
  Description of Artificial Sequence: Synthetic peptide
AAITNGGSTKYA

SEQ ID NO: 2511 - protein, 12 aa, Artificial Sequence
  Description of Artificial Sequence: Synthetic peptide
AAINRSGSTEYA

SEQ ID NO: 2512 - protein, 12 aa, Artificial Sequence
  Description of Artificial Sequence: Synthetic peptide
ASISRSGTTYYA

SEQ ID NO: 2513 - protein, 12 aa, Artificial Sequence
  Description of Artificial Sequence: Synthetic peptide
ASISRFGRTNYA

SEQ ID NO: 2514 - protein, 12 aa, Artificial Sequence
  Description of Artificial Sequence: Synthetic peptide
ARIWPGGSTYYA

SEQ ID NO: 2515 - protein, 14 aa, Artificial Sequence
  Description of Artificial Sequence: Synthetic peptide
AGINWRSGGSTYYA

SEQ ID NO: 2516 - protein, 12 aa, Artificial Sequence
  Description of Artificial Sequence: Synthetic peptide
ASISSGGTTAYA

SEQ ID NO: 2517 - protein, 12 aa, Artificial Sequence
  Description of Artificial Sequence: Synthetic peptide
AGINMISSTKYA

SEQ ID NO: 2518 - protein, 11 aa, Artificial Sequence
  Description of Artificial Sequence: Synthetic peptide
ARIAGGSTYYA

SEQ ID NO: 2519 - protein, 12 aa, Artificial Sequence
  Description of Artificial Sequence: Synthetic peptide
AAITSSGSTNYA

SEQ ID NO: 2520 - protein, 12 aa, Artificial Sequence
  Description of Artificial Sequence: Synthetic peptide
ASITKFGSTNYA

SEQ ID NO: 2521 - protein, 12 aa, Artificial Sequence
  Description of Artificial Sequence: Synthetic peptide
ASISRFGRTNYA

SEQ ID NO: 2522 - protein, 12 aa, Artificial Sequence
  Description of Artificial Sequence: Synthetic peptide
ARISSGGSTSYA

SEQ ID NO: 2523 - protein, 12 aa, Artificial Sequence
  Description of Artificial Sequence: Synthetic peptide
AAITSGGRTSYA

SEQ ID NO: 2524 - protein, 12 aa, Artificial Sequence
  Description of Artificial Sequence: Synthetic peptide
AQITRGGSTNYA

SEQ ID NO: 2525 - protein, 18 aa, Artificial Sequence
  Description of Artificial Sequence: Synthetic peptide
CAARRSQILFTSRTDYEW

SEQ ID NO: 2526 - protein, 22 aa, Artificial Sequence
  Description of Artificial Sequence: Synthetic peptide
CAAVNTFDESAYAAFACYDVVW

SEQ ID NO: 2527 - protein, 18 aa, Artificial Sequence
  Description of Artificial Sequence: Synthetic peptide
CAASSVFSDLRYRKNPKW

SEQ ID NO: 2528 - protein, 9 aa, Artificial Sequence
  Description of Artificial Sequence: Synthetic peptide
CAIAGRGRW

SEQ ID NO: 2529 - protein, 18 aa, Artificial Sequence
  Description of Artificial Sequence: Synthetic peptide
CAKTKRTGIFTTARMVDW

SEQ ID NO: 2530 - protein, 24 aa, Artificial Sequence
  Description of Artificial Sequence: Synthetic peptide
CAIEPGTIRNWRNRVPFARGNFGW

SEQ ID NO: 2531 - protein, 13 aa, Artificial Sequence
  Description of Artificial Sequence: Synthetic peptide
CAARRWIPPGPIW

SEQ ID NO: 2532 - protein, 17 aa, Artificial Sequence
  Description of Artificial Sequence: Synthetic peptide
CAAKRLRSFASGGSYDW

SEQ ID NO: 2533 - protein, 18 aa, Artificial Sequence
  Description of Artificial Sequence: Synthetic peptide
CAARRRVTLFTSRADYDW

SEQ ID NO: 2534 - protein, 13 aa, Artificial Sequence
  Description of Artificial Sequence: Synthetic peptide
CAARRWIPPGPIW

SEQ ID NO: 2535 - protein, 18 aa, Artificial Sequence
  Description of Artificial Sequence: Synthetic peptide
CAAKGIWDYLGRRDFGDW

SEQ ID NO: 2536 - protein, 23 aa, Artificial Sequence
  Description of Artificial Sequence: Synthetic peptide
CARQTFDFWSASLGGNFWYFDLW

SEQ ID NO: 2537 - protein, 9 aa, Artificial Sequence [sequence omitted]

SEQ ID NO: 2538 - protein, 16 aa, Artificial Sequence
  Description of Artificial Sequence: Synthetic peptide
CTRGGGRFFDWLYLRW

SEQ ID NO: 2539 - protein, 21 aa, Artificial Sequence
  Description of Artificial Sequence: Synthetic peptide
CARGHGRYFDWLLFARPPDYW

SEQ ID NO: 2540 - protein, 16 aa, Artificial Sequence
  Description of Artificial Sequence: Synthetic peptide
CAKRTIFGVGRWLDPW

SEQ ID NO: 2541 - protein, 20 aa, Artificial Sequence
  Description of Artificial Sequence: Synthetic peptide
CSKDRAPNCFACCPNGFDVW

SEQ ID NO: 2542 - protein, 12 aa, Artificial Sequence
  Description of Artificial Sequence: Synthetic peptide
CARGRFLGGTEW

SEQ ID NO: 2543 - protein, 18 aa, Artificial Sequence
  Description of Artificial Sequence: Synthetic peptide
CARGRTIFFGGGRYFDYW

SEQ ID NO: 2544 - protein, 25 aa, Artificial Sequence
  Description of Artificial Sequence: Synthetic peptide
CARGARIFGSVAPWRGGNYYGMDVW

SEQ ID NO: 2545 - protein, 15 aa, Artificial Sequence
  Description of Artificial Sequence: Synthetic peptide
CARASGLWFRRPHVW

SEQ ID NO: 2546 - protein, 21 aa, Artificial Sequence
  Description of Artificial Sequence: Synthetic peptide
CARVSRRPRSPPGYYYGMDVW

SEQ ID NO: 2547 - protein, 20 aa, Artificial Sequence
  Description of Artificial Sequence: Synthetic peptide
CTRARLRYFDWLFPTNFDYW

SEQ ID NO: 2548 - protein, 17 aa, Artificial Sequence
  Description of Artificial Sequence: Synthetic peptide
CARRVRRLWFRSYFDLW

SEQ ID NO: 2549 - protein, 16 aa, Artificial Sequence
  Description of Artificial Sequence: Synthetic peptide
CARERARWFGKFSVSW

SEQ ID NO: 2550 - protein, 11 aa, Artificial Sequence
  Description of Artificial Sequence: Synthetic peptide
SACGRLGFGAW

SEQ ID NO: 2551 - protein, 21 aa, Artificial Sequence
  Description of Artificial Sequence: Synthetic peptide
CARGGPPRLWGSYRRKYFDYW

SEQ ID NO: 2552 - protein, 13 aa, Artificial Sequence
  Description of Artificial Sequence: Synthetic peptide
CARGLGWLLGYYW

SEQ ID NO: 2553 - protein, 17 aa, Artificial Sequence
  Description of Artificial Sequence: Synthetic peptide
CTTSARSGWFWRYFDSW

SEQ ID NO: 2554 - protein, 20 aa, Artificial Sequence
  Description of Artificial Sequence: Synthetic peptide
CARRGLLQWFGAPNSWFDPW

SEQ ID NO: 2555 - protein, 19 aa, Artificial Sequence
  Description of Artificial Sequence: Synthetic peptide
CTTERDGLLWFRELFRPSW

SEQ ID NO: 2556 - protein, 16 aa, Artificial Sequence
  Description of Artificial Sequence: Synthetic peptide
CAKVHSYVWGGHSDYW

SEQ ID NO: 2557 - protein, 20 aa, Artificial Sequence
  Description of Artificial Sequence: Synthetic peptide
CARVRFSRLGGVIGRPIDSW

SEQ ID NO: 2558 - protein, 16 aa, Artificial Sequence
  Description of Artificial Sequence: Synthetic peptide
CAKDRGVLWFGELWYW

SEQ ID NO: 2559 - protein, 24 aa, Artificial Sequence
  Description of Artificial Sequence: Synthetic peptide
CASGKGGSATIFHLSRRPLYFDYW

SEQ ID NO: 2560 - protein, 20 aa, Artificial Sequence
  Description of Artificial Sequence: Synthetic peptide
CAKRKNRGPLWFGGGGWGYW

SEQ ID NO: 2561 - protein, 21 aa, Artificial Sequence
  Description of Artificial Sequence: Synthetic peptide
CARRVAYSSFWSGLRKHMDVW

SEQ ID NO: 2562 - protein, 14 aa, Artificial Sequence
  Description of Artificial Sequence: Synthetic peptide
CASRRRWLTPYIFW

SEQ ID NO: 2563 - protein, 12 aa, Artificial Sequence
  Description of Artificial Sequence: Synthetic peptide
CAAISIFGRLKW

SEQ ID NO: 2564 - protein, 21 aa, Artificial Sequence
  Description of Artificial Sequence: Synthetic peptide
CARVGPLRFLAQRPRLRPDYW

SEQ ID NO: 2565 - protein, 15 aa, Artificial Sequence
  Description of Artificial Sequence: Synthetic peptide
CAREWGRWLQRGSYW

SEQ ID NO: 2566 - protein, 24 aa, Artificial Sequence
  Description of Artificial Sequence: Synthetic peptide
CARGSGSGFMWYHGNNNYDRWRYW

SEQ ID NO: 2567 - protein, 19 aa, Artificial Sequence
  Description of Artificial Sequence: Synthetic peptide
CARGRYDFWSGYYRWFDPW

SEQ ID NO: 2568 - protein, 22 aa, Artificial Sequence
  Description of Artificial Sequence: Synthetic peptide
CATVPPPRRFLEWLPRRLTYIW

SEQ ID NO: 2569 - protein, 13 aa, Artificial Sequence
  Description of Artificial Sequence: Synthetic peptide
CARMSGFPFLDYW

SEQ ID NO: 2570 - protein, 18 aa, Artificial Sequence
  Description of Artificial Sequence: Synthetic peptide
CARTRGIFLWFGESFDYW

SEQ ID NO: 2571 - protein, 18 aa, Artificial Sequence
  Description of Artificial Sequence: Synthetic peptide
CARGGPRFGGFRGYFDPW

SEQ ID NO: 2572 - protein, 14 aa, Artificial Sequence
  Description of Artificial Sequence: Synthetic peptide
CARVTRWFGGLDVW

SEQ ID NO: 2573 - protein, 18 aa, Artificial Sequence
  Description of Artificial Sequence: Synthetic peptide
CARHHGLGILWWGTMDVW

SEQ ID NO: 2574 - protein, 15 aa, Artificial Sequence
  Description of Artificial Sequence: Synthetic peptide
CAKRSTWLPQHFDSW

SEQ ID NO: 2575 - protein, 16 aa, Artificial Sequence
  Description of Artificial Sequence: Synthetic peptide
CARGVRGVFRAYFDHW

SEQ ID NO: 2576 - protein, 23 aa, Artificial Sequence
  Description of Artificial Sequence: Synthetic peptide
CARGTSFFNFWSGSLGRVGFDSW

SEQ ID NO: 2577 - protein, 18 aa, Artificial Sequence
  Description of Artificial Sequence: Synthetic peptide
CTTAGVLRYFDWFRRPYW

SEQ ID NO: 2578 - protein, 21 aa, Artificial Sequence
  Description of Artificial Sequence: Synthetic peptide
CTTDGLRYFDWFPWASAFDIW

SEQ ID NO: 2579 - protein, 13 aa, Artificial Sequence
  Description of Artificial Sequence: Synthetic peptide
CARKGRWSGMNVW

SEQ ID NO: 2580 - protein, 21 aa, Artificial Sequence
  Description of Artificial Sequence: Synthetic peptide
CARSTGPRGSGRYRAHWFDSW

SEQ ID NO: 2581 - protein, 13 aa, Artificial Sequence
  Description of Artificial Sequence: Synthetic peptide
CSPSSWPFYFGAW

SEQ ID NO: 2582 - protein, 24 aa, Artificial Sequence
  Description of Artificial Sequence: Synthetic peptide
CARGTPWRLLWFGTLGPPPAFDYW

SEQ ID NO: 2583 - protein, 16 aa, Artificial Sequence
  Description of Artificial Sequence: Synthetic peptide
CARQHQDFWTGYYTVW

SEQ ID NO: 2584 - protein, 18 aa, Artificial Sequence
  Description of Artificial Sequence: Synthetic peptide
CAKEGWRWLQLRGGFDYW

SEQ ID NO: 2585 - protein, 17 aa, Artificial Sequence
  Description of Artificial Sequence: Synthetic peptide
CARRGKLSAAMHWFDPW

SEQ ID NO: 2586 - protein, 13 aa, Artificial Sequence
  Description of Artificial Sequence: Synthetic peptide
CARDRGIFGVSRW

SEQ ID NO: 2587 - protein, 11 aa, Artificial Sequence
  Description of Artificial Sequence: Synthetic peptide
CARGSGWWEYW

SEQ ID NO: 2588 - protein, 19 aa, Artificial Sequence
  Description of Artificial Sequence: Synthetic peptide
CARGFGRRFLEWLPRFDYW

SEQ ID NO: 2589 - protein, 16 aa, Artificial Sequence
  Description of Artificial Sequence: Synthetic peptide
CAHFRRFLPRGYVDYW

SEQ ID NO: 2590 - protein, 22 aa, Artificial Sequence
  Description of Artificial Sequence: Synthetic peptide
CARQQYYDFWSGYFRSGYFDLW

SEQ ID NO: 2591 - protein, 22 aa, Artificial Sequence
  Description of Artificial Sequence: Synthetic peptide
CATVPPPRRFLEWLPRRLTYTW

SEQ ID NO: 2592 - protein, 17 aa, Artificial Sequence
  Description of Artificial Sequence: Synthetic peptide
CAKERESRFLKWRKTDW

SEQ ID NO: 2593 - protein, 17 aa, Artificial Sequence
  Description of Artificial Sequence: Synthetic peptide
CARHDSIGLFRHGMDVW

SEQ ID NO: 2594 - protein, 20 aa, Artificial Sequence
  Description of Artificial Sequence: Synthetic peptide
CARDRGFGFWSGLRGYFDLW

SEQ ID NO: 2595 - protein, 20 aa, Artificial Sequence
  Description of Artificial Sequence: Synthetic peptide
CAKRKKRGPLWFGGGGWGYW

SEQ ID NO: 2596 - protein, 12 aa, Artificial Sequence
  Description of Artificial Sequence: Synthetic peptide
CARRHWFGFDYW

SEQ ID NO: 2597 - protein, 123 aa, Artificial Sequence
  Description of Artificial Sequence: Synthetic polypeptide
EVQLVESGGGLVQPGGSLRLSCAASGRTFSRLAMGWFRQAPGKEREFVAAISRSGRSTSYADSVKGRFTISADNSKNTAYLQMNSLKPEDTAVYYCAARRSQILFTSRTDYEWGQGTLVTVSS

SEQ ID NO: 2598 - protein, 126 aa, Artificial Sequence
  Description of Artificial Sequence: Synthetic polypeptide
EVQLVESGGGLVQPGGSLRLSCAASGSFSIAAMGWFRQAPGKEREFVATINYSGGGTYYADSVKGRFTISADNSKNTAYLQMNSLKPEDTAVYYCAAVNTFDESAYAAFACYDVVWGQGTLVTVSS

SEQ ID NO: 2599 - protein, 123 aa, Artificial Sequence
  Description of Artificial Sequence: Synthetic polypeptide
EVQLVESGGGLVQPGGSLRLSCAASGRTFSRYAMGWFRQAPGKEREFVAAISRSGKSTYYADSVKGRFTISADNSKNTAYLQMNSLKPEDTAVYYCAASSVFSDLRYRKNPKWGQGTLVTVSS

SEQ ID NO: 2600 - protein, 144 aa, Artificial Sequence
  Description of Artificial Sequence: Synthetic polypeptide
EVQLVESGGGLVQPGGSLRLSCAASGRTFSKYAMGWFRQAPGKEREFVSHISRDGGRTFSSSTMGWFRQAPGKERELVALITPSSRTTYYADSVKGRFTISADNSKNTAYLQMNSLKPEDTAVYYCAIAGRGRWGQGTLVTVSS

SEQ ID NO: 2601 - protein, 123 aa, Artificial Sequence
  Description of Artificial Sequence: Synthetic polypeptide
EVQLVESGGGLVQPGGSLRLSCAASGRTFRRYAMGWFRQAPGKEREFVASINWGGGNTYYADSVKGRFTISADNSKNTAYLQMNSLKPEDTAVYYCAKTKRTGIFTTARMVDWGQGTLVTVSS

SEQ ID NO: 2602 - protein, 129 aa, Artificial Sequence
  Description of Artificial Sequence: Synthetic polypeptide
EVQLVESGGGLVQPGGSLRLSCAASGRTFSRFAMGWFRQAPGKEREFVAAIRWSGGRTVYADSVKGRFTISADNSKNTAYLQMNSLKPEDTAVYYCAIEPGTIRNWRNRVPFARGNFGWGQGTLVTVSS

SEQ ID NO: 2603 - protein, 121 aa, Artificial Sequence
  Description of Artificial Sequence: Synthetic polypeptide
EVQLVESGGGLVQPGGSLRLSCAASGLGIAFSRRTAMGWFRQAPGKEREFVAAISWRGGNTYYADSVKGRFTISADNSKNTAYLQMNSLKPEDTAVYYCAARRWIPPGPIWGQGTLVTVSS

SEQ ID NO: 2604 - protein, 122 aa, Artificial Sequence
  Description of Artificial Sequence: Synthetic polypeptide
EVQLVESGGGLVQPGGSLRLSCAASGRTFRRYPMGWFRQAPGKEREFVAAISRSGGSTYYADSVKGRFTISADNSKNTAYLQMNSLKPEDTAVYYCAAKRLRSFASGGSYDWGQGTLVTVSS

SEQ ID NO: 2605 - protein, 123 aa, Artificial Sequence
  Description of Artificial Sequence: Synthetic polypeptide
EVQLVESGGGLVQPGGSLRLSCAASGGTLRGYGMGWFRQAPGKEREFVASISRSGGSTYYADSVKGRFTISADNSKNTAYLQMNSLKPEDTAVYYCAARRRVTLFTSRADYDWGQGTLVTVSS

SEQ ID NO: 2606 - protein, 118 aa, Artificial Sequence
  Description of Artificial Sequence: Synthetic polypeptide
EVQLVESGGGLVQPGGSLRLSCAASGRMFSSRSMGWFRQAPGKEREFVALINRSGGSQFYADSVKGRFTISADNSKNTAYLQMNSLKPEDTAVYYCAARRWIPPGPIWGQGTLVTVSS

SEQ ID NO: 2607 - protein, 122 aa, Artificial Sequence
  Description of Artificial Sequence: Synthetic polypeptide
EVQLVESGGGLVQPGGSLRLSCAASGRTFGRRAMGWFRQAPGKEREFVAGISRGGGTNYADSVKGRFTISADNSKNTAYLQMNSLKPEDTAVYYCAAKGIWDYLGRRDFGDWGQGTLVTVSS

SEQ ID NO: 2608 - protein, 131 aa, Artificial Sequence
  Description of Artificial Sequence: Synthetic polypeptide
EVQLVESGGGLVQPGGSLRLSCAASGLSSPPFDDFPMGWFRQAPGKEREFVSSIYSDDGDSMYADSVKGRFTISADNSKNTAYLQMNSLKPEDTAVYYCARQTFDFWSASLGGNFWYFDLWGQGTLVTVSS

SEQ ID NO: 2609 - protein, 117 aa, Artificial Sequence
  Description of Artificial Sequence: Synthetic polypeptide
EVQLVESGGGLVQPGGSLRLSCAASGGTFSSYSMGWFRQAPGKEREFVSAISWIIGSGGTTNYADSVKGRFTISADNSKNTAYLQMNSLKPEDTAVYYCTAGAGDSWGQGTLVTVSS

SEQ ID NO: 2610 - protein, 120 aa, Artificial Sequence
  Description of Artificial Sequence: Synthetic polypeptide
EVQLVESGGGLVQPGGSLRLSCAASGSIFSTRTMGWFRQAPGKEREFVASITKFGSTNYADSVKGRFTISADNSKNTAYLQMNSLKPEDTAVYYCTRGGGRFFDWLYLRWGQGTLVTVSS

SEQ ID NO: 2611 - protein, 125 aa, Artificial Sequence
  Description of Artificial Sequence: Synthetic polypeptide
EVQLVESGGGLVQPGGSLRLSCAASGRTLWRSNMGWFRQAPGKEREFVASISSFGSTKYADSVKGRFTISADNSKNTAYLQMNSLKPEDTAVYYCARGHGRYFDWLLFARPPDYWGQGTLVTVSS

SEQ ID NO: 2612 - protein, 120 aa, Artificial Sequence
  Description of Artificial Sequence: Synthetic polypeptide
EVQLVESGGGLVQPGGSLRLSCAASGRSLGIYRMGWFRQAPGKEREFVAAITSGGRKNYADSVKGRFTISADNSKNTAYLQMNSLKPEDTAVYYCAKRTIFGVGRWLDPWGQGTLVTVSS

SEQ ID NO: 2613 - protein, 124 aa, Artificial Sequence
  Description of Artificial Sequence: Synthetic polypeptide
EVQLVESGGGLVQPGGSLRLSCAASGTTLTFRIMGWFRQAPGKEREFVPAISSTGLASYTDSVKGRFTISADNSKNTAYLQMNSLKPEDTAVYYCSKDRAPNCFACCPNGFDVWGQGTLVTVSS

SEQ ID NO: 2614 - protein, 121 aa, Artificial Sequence
  Description of Artificial Sequence: Synthetic polypeptide
EVQLVESGGGLVQPGGSLRLSCAASGSRFSGRFNILNMGWFRQAPGKEREFVARIGYSGQSISYADSVKGRFTISADNSKNTAYLQMNSLKPEDTAVYYCARGRFLGGTEWGQGTLVTVSS

SEQ ID NO: 2615 - protein, 122 aa, Artificial Sequence
  Description of Artificial Sequence: Synthetic polypeptide
EVQLVESGGGLVQPGGSLRLSCAASGTLFKINAMGWFRQAPGKEREFVAQINRHGVTYYADSVKGRFTISADNSKNTAYLQMNSLKPEDTAVYYCARGRTIFFGGGRYFDYWGQGTLVTVSS

SEQ ID NO: 2616 - protein, 130 aa, Artificial Sequence
  Description of Artificial Sequence: Synthetic polypeptide
EVQLVESGGGLVQPGGSLRLSCAASGIPFRSRTMGWFRQAPGKEREFVAGITGSGRSQYYADSVKGRFTISADNSKNTAYLQMNSLKPEDTAVYYCARGARIFGSVAPWRGGNYYGMDVWGQGTLVTVSS

SEQ ID NO: 2617 - protein, 119 aa, Artificial Sequence
  Description of Artificial Sequence: Synthetic polypeptide
EVQLVESGGGLVQPGGSLRLSCAASGFTFSSFRMGWFRQAPGKEREFVAGISRGGSTNYADSVKGRFTISADNSKNTAYLQMNSLKPEDTAVYYCARASGLWFRRPHVWGQGTLVTVSS

SEQ ID NO: 2618 - protein, 126 aa, Artificial Sequence
  Description of Artificial Sequence: Synthetic polypeptide
EVQLVESGGGLVQPGGSLRLSCAASGRNFRRNSMGWFRQAPGKEREFVAGISWSGARTHYADSVKGRFTISADNSKNTAYLQMNSLKPEDTAVYYCARVSRRPRSPPGYYYGMDVWGQGTLVTVSS

SEQ ID NO: 2619 - protein, 125 aa, Artificial Sequence
  Description of Artificial Sequence: Synthetic polypeptide
EVQLVESGGGLVQPGGSLRLSCAASGRNLRMYRMGWFRQAPGKEREFVATIRWSDGSTYYADSVKGRFTISADNSKNTAYLQMNSLKPEDTAVYYCTRARLRYFDWLFPTNFDYWGQGTLVTVSS

SEQ ID NO: 2620 - protein, 122 aa, Artificial Sequence
  Description of Artificial Sequence: Synthetic polypeptide
EVQLVESGGGLVQPGGSLRLSCAASGGLTFSSNTMGWFRQAPGKEREFVASISSSGRTSYADSVKGRFTISADNSKNTAYLQMNSLKPEDTAVYYCARRVRRLWFRSYFDLWGQGTLVTVSS

SEQ ID NO: 2621 - protein, 121 aa, Artificial Sequence
  Description of Artificial Sequence: Synthetic polypeptide
EVQLVESGGGLVQPGGSLRLSCAASGFTLAYYAMGWFRQAPGKEREFVAAISWSGRNINYADSVKGRFTISADNSKNTAYLQMNSLKPEDTAVYYCARERARWFGKFSVSWGQGTLVTVSS

SEQ ID NO: 2622 - protein, 115 aa, Artificial Sequence
  Description of Artificial Sequence: Synthetic polypeptide
EVQLVESGGGLVQPGGSLRLSCAASGRTFSSFPMGWFRQAPGKEREFVAAISWSGSTSYADSVKGRFTISADNSKNTAYLQMNSLKPEDTAVYYSACGRLGFGAWGQGTLVTVSS

SEQ ID NO: 2623 - protein, 125 aa, Artificial Sequence
  Description of Artificial Sequence: Synthetic polypeptide
EVQLVESGGGLVQPGGSLRLSCAASGISSSKRNMGWFRQAPGKEREFVATWTSRGITTYADSVKGRFTISADNSKNTAYLQMNSLKPEDTAVYYCARGGPPRLWGSYRRKYFDYWGQGTLVTVSS

SEQ ID NO: 2624 - protein, 117 aa, Artificial Sequence
  Description of Artificial Sequence: Synthetic polypeptide
EVQLVESGGGLVQPGGSLRLSCAASGRTFSIYAMGWFRQAPGKEREFVARITRGGITKYADSVKGRFTISADNSKNTAYLQMNSLKPEDTAVYYCARGLGWLLGYYWGQGTLVTVSS

SEQ ID NO: 2625 - protein, 120 aa, Artificial Sequence
  Description of Artificial Sequence: Synthetic polypeptide
EVQLVESGGGLVQPGGSLRLSCAASGRMYNSYSMGWFRQAPGKEREFVARISPGGTFYADSVKGRFTISADNSKNTAYLQMNSLKPEDTAVYYCTTSARSGWFWRYFDSWGQGTLVTVSS

SEQ ID NO: 2626 - protein, 124 aa, Artificial Sequence
  Description of Artificial Sequence: Synthetic polypeptide
EVQLVESGGGLVQPGGSLRLSCAASGRTFRSYGMGWFRQAPGKEREFVASISRSGTTMYADSVKGRFTISADNSKNTAYLQMNSLKPEDTAVYYCARRGLLQWFGAPNSWFDPWGQGTLVTVSS

SEQ ID NO: 2627 - protein, 121 aa, Artificial Sequence
  Description of Artificial Sequence: Synthetic polypeptide
EVQLVESGGGLVQPGGSLRLSCAASGRTIRTMGWFRQAPGKEREFVATINSRGITNYADSVKGRFTISADNSKNTAYLQMNSLKPEDTAVYYCTTERDGLLWFRELFRPSWGQGTLVTVSS

SEQ ID NO: 2628 - protein, 120 aa, Artificial Sequence
  Description of Artificial Sequence: Synthetic polypeptide
EVQLVESGGGLVQPGGSLRLSCAASGRSFSFNAMGWFRQAPGKEREFVARISRFGRTNYADSVKGRFTISADNSKNTAYLQMNSLKPEDTAVYYCAKVHSYVWGGHSDYWGQGTLVTVSS

SEQ ID NO: 2629 - protein, 123 aa, Artificial Sequence
  Description of Artificial Sequence: Synthetic polypeptide
EVQLVESGGGLVQPGGSLRLSCAASGRTYYAMGWFRQAPGKEREFVGAIDWSGRRITYADSVKGRFTISADNSKNTAYLQMNSLKPEDTAVYYCARVRFSRLGGVIGRPIDSWGQGTLVTVSS

SEQ ID NO: 2630 - protein, 120 aa, Artificial Sequence
  Description of Artificial Sequence: Synthetic polypeptide
EVQLVESGGGLVQPGGSLRLSCAASGRAFRRYTMGWFRQAPGKEREFVASITKFGSTNYADSVKGRFTISADNSKNTAYLQMNSLKPEDTAVYYCAKDRGVLWFGELWYWGQGTLVTVSS

SEQ ID NO: 2631 - protein, 128 aa, Artificial Sequence
  Description of Artificial Sequence: Synthetic polypeptide
EVQLVESGGGLVQPGGSLRLSCAASGRTFSNYRMGWFRQAPGKEREFVASINRGGSTKYADSVKGRFTISADNSKNTAYLQMNSLKPEDTAVYYCASGKGGSATIFHLSRRPLYFDYWGQGTLVTVSS

SEQ ID NO: 2632 - protein, 125 aa, Artificial Sequence
  Description of Artificial Sequence: Synthetic polypeptide
EVQLVESGGGLVQPGGSLRLSCAASGITFSPYAMGWFRQAPGKEREFVATINWSGGYTVYADSVKGRFTISADNSKNTAYLQMNSLKPEDTAVYYCAKRKNRGPLWFGGGGWGYWGQGTLVTVSS

SEQ ID NO: 2633 - protein, 130 aa, Artificial Sequence
  Description of Artificial Sequence: Synthetic polypeptide
EVQLVESGGGLVQPGGSLRLSCAASGRTFSGFTMSSTWMGWFRQAPGKEREFVAGIITNGSTNYADSVKGRFTISADNSKNTAYLQMNSLKPEDTAVYYCARRVAYSSFWSGLRKHMDVWGQGTLVTVSS

SEQ ID NO: 2634 - protein, 118 aa, Artificial Sequence
  Description of Artificial Sequence: Synthetic polypeptide
EVQLVESGGGLVQPGGSLRLSCAASGRTFRRYSMGWFRQAPGKEREFVASITPGGNTNYADSVKGRFTISADNSKNTAYLQMNSLKPEDTAVYYCASRRRWLTPYIFWGQGTLVTVSS

SEQ ID NO: 2635 - protein, 116 aa, Artificial Sequence
  Description of Artificial Sequence: Synthetic polypeptide
EVQLVESGGGLVQPGGSLRLSCAASGSIFSIGMGWFRQAPGKEREFVARIWWRSGATYYADSVKGRFTISADNSKNTAYLQMNSLKPEDTAVYYCAAISIFGRLKWGQGTLVTVSS

SEQ ID NO: 2636 - protein, 126 aa, Artificial Sequence
  Description of Artificial Sequence: Synthetic polypeptide
EVQLVESGGGLVQPGGSLRLSCAASGRTFTSYRMGWFRQAPGKEREFVAEISSSGGYTYYADSVKGRFTISADNSKNTAYLQMNSLKPEDTAVYYCARVGPLRFLAQRPRLRPDYWGQGTLVTVSS

SEQ ID NO: 2637 - protein, 122 aa, Artificial Sequence
  Description of Artificial Sequence: Synthetic polypeptide
EVQLVESGGGLVQPGGSLRLSCAASGRTFSSFRFRAMGWFRQAPGKEREFVALIFSGGSTYYADSVKGRFTISADNSKNTAYLQMNSLKPEDTAVYYCAREWGRWLQRGSYWGQGTLVTVSS

SEQ ID NO: 2638 - protein, 128 aa, Artificial Sequence
  Description of Artificial Sequence: Synthetic polypeptide
EVQLVESGGGLVQPGGSLRLSCAASGRTFGSYGMGWFRQAPGKEREFVATISIGGRTYYADSVKGRFTISADNSKNTAYLQMNSLKPEDTAVYYCARGSGSGFMWYHGNNNYDRWRYWGQGTLVTVSS

SEQ ID NO: 2639 - protein, 123 aa, Artificial Sequence
  Description of Artificial Sequence: Synthetic polypeptide
EVQLVESGGGLVQPGGSLRLSCAASGRTFRSYPMGWFRQAPGKEREFVASINRGGSTNYADSVKGRFTISADNSKNTAYLQMNSLKPEDTAVYYCARGRYDFWSGYYRWFDPWGQGTLVTVSS

SEQ ID NO: 2640 - protein, 127 aa, Artificial Sequence
  Description of Artificial Sequence: Synthetic polypeptide
EVQLVESGGGLVQPGGSLRLSCAASGRTFSRSDMGWFRQAPGKEREFVAAISWSGGSTSYADSVKGRFTISADNSKNTAYLQMNSLKPEDTAVYYCATVPPPRRFLEWLPRRLTYIWGQGTLVTVSS

SEQ ID NO: 2641 - protein, 116 aa, Artificial Sequence
  Description of Artificial Sequence: Synthetic polypeptide
EVQLVESGGGLVQPGGSLRLSCAASGRTFRRYTMGWFRQAPGKEREFVASMRGSRSYYADSVKGRFTISADNSKNTAYLQMNSLKPEDTAVYYCARMSGFPFLDYWGQGTLVTVSS

SEQ ID NO: 2642 - protein, 122 aa, Artificial Sequence
  Description of Artificial Sequence: Synthetic polypeptide
EVQLVESGGGLVQPGGSLRLSCAASGSIFRLSTMGWFRQAPGKEREFVASISSFGSTYYADSVKGRFTISADNSKNTAYLQMNSLKPEDTAVYYCARTRGIFLWFGESFDYWGQGTLVTVSS

SEQ ID NO: 2643 - protein, 122 aa, Artificial Sequence
  Description of Artificial Sequence: Synthetic polypeptide
EVQLVESGGGLVQPGGSLRLSCAASGIAFRIRTMGWFRQAPGKEREFVASITSGGSTNYADSVKGRFTISADNSKNTAYLQMNSLKPEDTAVYYCARGGPRFGGFRGYFDPWGQGTLVTVSS

SEQ ID NO: 2644 - protein, 119 aa, Artificial Sequence
  Description of Artificial Sequence: Synthetic polypeptide
EVQLVESGGGLVQPGGSLRLSCAASGFTFTSYRMGWFRQAPGKEREFVAGISRFFGTAYYADSVKGRFTISADNSKNTAYLQMNSLKPEDTAVYYCARVTRWFGGLDVWGQGTLVTVSS

SEQ ID NO: 2645 - protein, 122 aa, Artificial Sequence
  Description of Artificial Sequence: Synthetic polypeptide
EVQLVESGGGLVQPGGSLRLSCAASGRTFSRYVMGWFRQAPGKEREFVASISRFGRTNYADSVKGRFTISADNSKNTAYLQMNSLKPEDTAVYYCARHHGLGILWWGTMDVWGQGTLVTVSS

SEQ ID NO: 2646 - protein, 116 aa, Artificial Sequence
  Description of Artificial Sequence: Synthetic polypeptide
EVQLVESGGGLVQPGGSLRLSCAASGRTFSMGWFRQAPGKEREFVASISRFGRTNYADSVKGRFTISADNSKNTAYLQMNSLKPEDTAVYYCAKRSTWLPQHFDSWGQGTLVTVSS

SEQ ID NO: 2647 - protein, 121 aa, Artificial Sequence
  Description of Artificial Sequence: Synthetic polypeptide
EVQLVESGGGLVQPGGSLRLSCAASGRTFSTYTMGWFRQAPGKEREFVARIWRSGGNTYYADSVKGRFTISADNSKNTAYLQMNSLKPEDTAVYYCARGVRGVFRAYFDHWGQGTLVTVSS

SEQ ID NO: 2648 - protein, 127 aa, Artificial Sequence
  Description of Artificial Sequence: Synthetic polypeptide
EVQLVESGGGLVQPGGSLRLSCAASGRNLRMYRMGWFRQAPGKEREFVALISRVGVTSYADSVKGRFTISADNSKNTAYLQMNSLKPEDTAVYYCARGTSFFNFWSGSLGRVGFDSWGQGTLVTVSS

SEQ ID NO: 2649 - protein, 123 aa, Artificial Sequence
  Description of Artificial Sequence: Synthetic polypeptide
EVQLVESGGGLVQPGGSLRLSCAASGITIRTHAMGWFRQAPGKEREFVATISRSGGNTYYADSVKGRFTISADNSKNTAYLQMNSLKPEDTAVYYCTTAGVLRYFDWFRRPYWGQGTLVTVSS

SEQ ID NO: 2650 - protein, 125 aa, Artificial Sequence
  Description of Artificial Sequence: Synthetic polypeptide
EVQLVESGGGLVQPGGSLRLSCAASGRTFRRYHMGWFRQAPGKEREFVAAITSGGRTNYADSVKGRFTISADNSKNTAYLQMNSLKPEDTAVYYCTTDGLRYFDWFPWASAFDIWGQGTLVTVSS

SEQ ID NO: 2651 - protein, 118 aa, Artificial Sequence
  Description of Artificial Sequence: Synthetic polypeptide
EVQLVESGGGLVQPGGSLRLSCAASGRTFRRYTMGWFRQAPGKEREFVAVISWSGGSTKYADSVKGRFTISADNSKNTAYLQMNSLKPEDTAVYYCARKGRWSGMNVWGQGTLVTVSS

SEQ ID NO: 2652 - protein, 126 aa, Artificial Sequence
  Description of Artificial Sequence: Synthetic polypeptide
EVQLVESGGGLVQPGGSLRLSCAASGRTFSWYPMGWFRQAPGKEREFVASISWGGARTYYADSVKGRFTISADNSKNTAYLQMNSLKPEDTAVYYCARSTGPRGSGRYRAHWFDSWGQGTLVTVSS

SEQ ID NO: 2653 - protein, 118 aa, Artificial Sequence
  Description of Artificial Sequence: Synthetic polypeptide
EVQLVESGGGLVQPGGSLRLSCAASGRTFTSYRMGWFRQAPGKEREFVAAITWNSGRTRYADSVKGRFTISADNSKNTAYLQMNSLKPEDTAVYYCSPSSWPFYFGAWGQGTLVTVSS

SEQ ID NO: 2654 - protein, 128 aa, Artificial Sequence
  Description of Artificial Sequence: Synthetic polypeptide
EVQLVESGGGLVQPGGSLRLSCAASGRPLRRYVMGWFRQAPGKEREFVAAITNGGSTKYADSVKGRFTISADNSKNTAYLQMNSLKPEDTAVYYCARGTPWRLLWFGTLGPPPAFDYWGQGTLVTVSS

SEQ ID NO: 2655 - protein, 120 aa, Artificial Sequence
  Description of Artificial Sequence: Synthetic polypeptide
EVQLVESGGGLVQPGGSLRLSCAASGRTFRRYAMGWFRQAPGKEREFVAAINRSGSTEYADSVKGRFTISADNSKNTAYLQMNSLKPEDTAVYYCARQHQDFWTGYYTVWGQGTLVTVSS

SEQ ID NO: 2656 - protein, 122 aa, Artificial Sequence
  Description of Artificial Sequence: Synthetic polypeptide
EVQLVESGGGLVQPGGSLRLSCAASGRTFRRYTMGWFRQAPGKEREFVASISRSGTTYYADSVKGRFTISADNSKNTAYLQMNSLKPEDTAVYYCAKEGWRWLQLRGGFDYWGQGTLVTVSS

SEQ ID NO: 2657 - protein, 121 aa, Artificial Sequence
  Description of Artificial Sequence: Synthetic polypeptide
EVQLVESGGGLVQPGGSLRLSCAASGRTLSTYNMGWFRQAPGKEREFVASISRFGRTNYADSVKGRFTISADNSKNTAYLQMNSLKPEDTAVYYCARRGKLSAAMHWFDPWGQGTLVTVSS

SEQ ID NO: 2658 - protein, 117 aa, Artificial Sequence
  Description of Artificial Sequence: Synthetic polypeptide
EVQLVESGGGLVQPGGSLRLSCAASGRFFSTRVMGWFRQAPGKEREFVARIWPGGSTYYADSVKGRFTISADNSKNTAYLQMNSLKPEDTAVYYCARDRGIFGVSRWGQGTLVTVSS

SEQ ID NO: 2659 - protein, 117 aa, Artificial Sequence
  Description of Artificial Sequence: Synthetic polypeptide
EVQLVESGGGLVQPGGSLRLSCAASGRFFSICSMGWFRQAPGKEREFVAGINWRSGGSTYYADSVKGRFTISADNSKNTAYLQMNSLKPEDTAVYYCARGSGWWEYWGQGTLVTVSS

SEQ ID NO: 2660 - protein, 124 aa, Artificial Sequence
  Description of Artificial Sequence: Synthetic polypeptide
EVQLVESGGGLVQPGGSLRLSCAASGRMFSSRSNMGWFRQAPGKEREFVASISSGGTTAYADSVKGRFTISADNSKNTAYLQMNSLKPEDTAVYYCARGFGRRFLEWLPRFDYWGQGTLVTVSS

SEQ ID NO: 2661 - protein, 120 aa, Artificial Sequence
  Description of Artificial Sequence: Synthetic polypeptide
EVQLVESGGGLVQPGGSLRLSCAASGRTFSSARMGWFRQAPGKEREFVAGINMISSTKYADSVKGRFTISADNSKNTAYLQMNSLKPEDTAVYYCAHFRRFLPRGYVDYWGQGTLVTVSS

SEQ ID NO: 2662 - protein, 125 aa, Artificial Sequence
  Description of Artificial Sequence: Synthetic polypeptide
EVQLVESGGGLVQPGGSLRLSCAASGRTFRRYTMGWFRQAPGKEREFVARIAGGSTYYADSVKGRFTISADNSKNTAYLQMNSLKPEDTAVYYCARQQYYDFWSGYFRSGYFDLWGQGTLVTVSS

SEQ ID NO: 2663 - protein, 126 aa, Artificial Sequence
  Description of Artificial Sequence: Synthetic polypeptide
EVQLVESGGGLVQPGGSLRLSCAASGHTFRNYGMGWFRQAPGKEREFVAAITSSGSTNYADSVKGRFTISADNSKNTAYLQMNSLKPEDTAVYYCATVPPPRRFLEWLPRRLTYTWGQGTLVTVSS

SEQ ID NO: 2664 - protein, 121 aa, Artificial Sequence
  Description of Artificial Sequence: Synthetic polypeptide
EVQLVESGGGLVQPGGSLRLSCAASGRTFSRYAMGWFRQAPGKEREFVASITKFGSTNYADSVKGRFTISADNSKNTAYLQMNSLKPEDTAVYYCAKERESRFLKWRKTDWGQGTLVTVSS

SEQ ID NO: 2665 - protein, 121 aa, Artificial Sequence
  Description of Artificial Sequence: Synthetic polypeptide
EVQLVESGGGLVQPGGSLRLSCAASGRNLRMYRMGWFRQAPGKEREFVASISRFGRTNYADSVKGRFTISADNSKNTAYLQMNSLKPEDTAVYYCARHDSIGLFRHGMDVWGQGTLVTVSS

SEQ ID NO: 2666 - protein, 124 aa, Artificial Sequence
  Description of Artificial Sequence: Synthetic polypeptide
EVQLVESGGGLVQPGGSLRLSCAASGRTFRRYAMGWFRQAPGKEREFVARISSGGSTSYADSVKGRFTISADNSKNTAYLQMNSLKPEDTAVYYCARDRGFGFWSGLRGYFDLWGQGTLVTVSS

SEQ ID NO: 2667 - protein, 123 aa, Artificial Sequence
  Description of Artificial Sequence: Synthetic polypeptide
EVQLVESGGGLVQPGGSLRLSCAASGIPASMYLGWFRQAPGKEREFVAAITSGGRTSYADSVKGRFTISADNSKNTAYLQMNSLKPEDTAVYYCAKRKKRGPLWFGGGGWGYWGQGTLVTVSS

SEQ ID NO: 2668 - protein, 121 aa, Artificial Sequence
  Description of Artificial Sequence: Synthetic polypeptide
EVQLVESGGGLVQPGGSLRLSCAASGIPFRSRTFSAYAMGWFRQAPGKEREFVAQITRGGSTNYADSVKGRFTISADNSKNTAYLQMNSLKPEDTAVYYCARRHWFGFDYWGQGTLVTVSS

SEQ ID NO: 2669 - DNA, 62 bp, Artificial Sequence
  Description of Artificial Sequence: Synthetic oligonucleotide
  modified_base (51)..(52): Thymidine-succinyl hexamide CED phosphoramidite
agacaatcaaccatttggggtggacagccttgacctctagacttcggcattttttttttttt

SEQ ID NO: 2670 - DNA, 112 bp, Artificial Sequence
  Description of Artificial Sequence: Synthetic polynucleotide
  modified_base (101)..(102): Thymidine-succinyl hexamide CED phosphoramidite
cgggatccttatcgtcatcgtcgtacagatcccgacccatttgctgtccaccagtcatgctagccataccatgatgatgatgatgatgagaaccccgcattttttttttttt

SEQ ID NO: 2671 - DNA, 19 bp, Artificial Sequence
  Description of Artificial Sequence: Synthetic primer
atgcggggttctcatcatc

SEQ ID NO: 2672 - DNA, 20 bp, Artificial Sequence
  Description of Artificial Sequence: Synthetic primer
cgggatccttatcgtcatcg

SEQ ID NO: 2673 - protein, 498 aa, Artificial Sequence
  Description of Artificial Sequence: Synthetic polypeptide
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQGLNDIFEAQKIEWHEGSLEVLFQGPGTSVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSKLSKDPNEKRDHMVLLEFVTAAGITLGMDELYKHHHHHHHHHH

What is claimed is:

1. A VHH antibody that binds to ACE2 protein, comprising a variable domain, heavy chain region (VH) wherein VH comprises complementarity determining regions CDRH1, CDRH2, and CDRH3, wherein (a) an amino acid sequence of CDRH1 is as set forth in SEQ ID NO: 39; (b) an amino acid sequence of CDRH2 is as set forth in SEQ ID NO: 89; and (c) an amino acid sequence of CDRH3 is as set forth in SEQ ID NO: 139.

2. A VHH antibody that binds to ACE2 protein, comprising a variable domain, heavy chain region (VH) wherein VH comprises complementarity determining regions CDRH1, CDRH2, and CDRH3, wherein (a) an amino acid sequence of CDRH1 is as set forth in SEQ ID NO: 785; (b) an amino acid sequence of CDRH2 is as set forth in SEQ ID NO: 926; and (c) an amino acid sequence of CDRH3 is as set forth in SEQ ID NO: 1068.

3. A VHH antibody that binds to ACE2 protein, comprising a variable domain, heavy chain region (VH) wherein VH comprises complementarity determining regions CDRH1, CDRH2, and CDRH3, wherein (a) an amino acid sequence of CDRH1 is as set forth in SEQ ID NO: 17; (b) an amino acid sequence of CDRH2 is as set forth in SEQ ID NO: 67; and (c) an amino acid sequence of CDRH3 is as set forth in SEQ ID NO: 117.

4. A VHH antibody that binds to ACE2 protein, comprising a variable domain, heavy chain region (VH) wherein VH comprises complementarity determining regions CDRH1, CDRH2, and CDRH3, wherein (a) an amino acid sequence of CDRH1 is as set forth in SEQ ID NO: 832; (b) an amino acid sequence of CDRH2 is as set forth in SEQ ID NO: 973; and (c) an amino acid sequence of CDRH3 is as set forth in SEQ ID NO: 1115.

\* \* \* \* \*